US012435323B2

(12) United States Patent
Alexander et al.

(10) Patent No.: US 12,435,323 B2
(45) Date of Patent: Oct. 7, 2025

(54) ENZYMES WITH RUVC DOMAINS

(71) Applicant: Metagenomi, Inc., Emeryville, CA (US)

(72) Inventors: Lisa Alexander, Albany, CA (US); Daniela S. A. Goltsman, Oakland, CA (US); Sarah Laperriere, Berkeley, CA (US); Morayma Temoche-Diaz, Oakland, CA (US)

(73) Assignee: Metagenomi, Inc., Emeryville, CA (US)

( * ) Notice: Subject to any disclaimer, the term of this patent is extended or adjusted under 35 U.S.C. 154(b) by 0 days.

(21) Appl. No.: 18/586,929

(22) Filed: Feb. 26, 2024

(65) Prior Publication Data

US 2024/0200047 A1 Jun. 20, 2024

Related U.S. Application Data

(63) Continuation of application No. PCT/US2022/041755, filed on Aug. 29, 2022.

(60) Provisional application No. 63/369,858, filed on Jul. 29, 2022, provisional application No. 63/322,944, filed on Mar. 23, 2022, provisional application No. 63/319,681, filed on Mar. 14, 2022, provisional application No. 63/316,895, filed on Mar. 4, 2022, provisional application No. 63/282,909, filed on Nov. 24, 2021, provisional application No. 63/252,956, filed on Oct. 6, 2021, provisional application No. 63/245,629, filed on Sep. 17, 2021, provisional application No. 63/237,791, filed on Aug. 27, 2021.

(51) Int. Cl.
*C12N 9/22* (2006.01)
*C12N 15/10* (2006.01)
*C12N 15/11* (2006.01)

(52) U.S. Cl.
CPC ............ *C12N 9/22* (2013.01); *C12N 15/102* (2013.01); *C12N 15/11* (2013.01); *C12N 2310/20* (2017.05)

(58) Field of Classification Search
CPC ........................................................ C12N 9/22
See application file for complete search history.

(56) References Cited

U.S. PATENT DOCUMENTS

| | | | |
|---|---|---|---|
| 5,858,988 | A | 1/1999 | Wang |
| 6,291,438 | B1 | 9/2001 | Wang |
| 8,889,418 | B2 | 11/2014 | Zhang et al. |
| 10,011,849 | B1 | 7/2018 | Gill et al. |
| 10,253,365 | B1 | 4/2019 | Doudna et al. |
| 10,392,607 | B2 | 8/2019 | Sternberg et al. |
| 10,913,941 | B2 | 2/2021 | Thomas et al. |
| 10,982,200 | B2 | 4/2021 | Thomas et al. |
| 11,946,039 | B2 | 4/2024 | Thomas et al. |
| 12,024,727 | B2 | 7/2024 | Thomas et al. |
| 2014/0186919 | A1 | 7/2014 | Zhang et al. |
| 2014/0186958 | A1 | 7/2014 | Zhang et al. |
| 2014/0273234 | A1 | 9/2014 | Zhang et al. |
| 2015/0045546 | A1 | 2/2015 | Siksnys et al. |
| 2016/0138046 | A1 | 5/2016 | Wu et al. |
| 2016/0289700 | A1 | 10/2016 | Barrangou et al. |
| 2016/0362667 | A1 | 12/2016 | Donohoue et al. |
| 2018/0312824 | A1 | 11/2018 | Zhang et al. |
| 2018/0371498 | A1 | 12/2018 | Gill et al. |
| 2019/0010471 | A1 | 1/2019 | Zhang et al. |
| 2019/0062735 | A1 | 2/2019 | Welstead et al. |
| 2019/0249200 | A1 | 8/2019 | Seebeck et al. |
| 2019/0264232 | A1 | 8/2019 | Hou et al. |
| 2020/0032240 | A1 | 1/2020 | Wang et al. |
| 2020/0080067 | A1 | 3/2020 | Zhang et al. |
| 2020/0263165 | A1 | 8/2020 | Bendezu et al. |
| 2020/0302240 | A1 | 9/2020 | Murata et al. |
| 2020/0332273 | A1 | 10/2020 | Thomas et al. |
| 2022/0033791 | A1 | 2/2022 | Thomas et al. |
| 2022/0220460 | A1 | 7/2022 | Thomas et al. |
| 2022/0298494 | A1 | 9/2022 | Thomas et al. |
| 2022/0364067 | A1 | 11/2022 | Lin et al. |
| 2022/0403357 | A1 | 12/2022 | Zhang et al. |
| 2024/0110167 | A1 | 4/2024 | Thomas et al. |
| 2024/0117330 | A1 | 4/2024 | Thomas et al. |
| 2024/0209332 | A1 | 6/2024 | Thomas et al. |
| 2024/0309356 | A1 | 9/2024 | Thomas et al. |
| 2024/0344045 | A1 | 10/2024 | Thomas et al. |

FOREIGN PATENT DOCUMENTS

| | | | |
|---|---|---|---|
| CA | 3091267 | A1 | 8/2019 |
| CN | 104520429 | A | 4/2015 |
| CN | 105142669 | A | 12/2015 |
| CN | 105209621 | A | 12/2015 |
| CN | 112126661 | A | 12/2020 |
| EP | 3141604 | A1 | 3/2017 |
| EP | 3617311 | A1 | 3/2020 |
| EP | 3699268 | A1 | 8/2020 |
| EP | 3854877 | A1 | 7/2021 |

(Continued)

OTHER PUBLICATIONS

Adronescu, M. et al., "Efficient Parameter Estimation for RNA Secondary Structure Prediction", Bioinformatics, 2007, vol. 23, pp. i19-i28.

(Continued)

*Primary Examiner* — Suzanne M Noakes

(74) *Attorney, Agent, or Firm* — Wilson Sonsini Goodrich & Rosati

(57) ABSTRACT

The present disclosure provides for endonuclease enzymes having distinguishing domain features, as well as methods of using such enzymes or variants thereof.

30 Claims, 36 Drawing Sheets

Specification includes a Sequence Listing.

(56) References Cited

FOREIGN PATENT DOCUMENTS

| | | | |
|---|---|---|---|
| EP | 4308699 | A1 | 1/2024 |
| JP | 2019507599 | A | 3/2019 |
| JP | 2019534695 | A | 12/2019 |
| JP | 2022520428 | A | 3/2022 |
| WO | WO-2015066119 | A1 | 5/2015 |
| WO | WO-2015161276 | A2 | 10/2015 |
| WO | WO-2016073990 | A2 | 5/2016 |
| WO | WO-2016141224 | A1 | 9/2016 |
| WO | WO-2016160721 | A1 | 10/2016 |
| WO | WO-2016183041 | A2 | 11/2016 |
| WO | WO-2016186953 | A1 | 11/2016 |
| WO | WO-2016196655 | A1 | 12/2016 |
| WO | WO-2017093969 | A1 | 6/2017 |
| WO | WO-2017152015 | A1 | 9/2017 |
| WO | WO-2017155714 | A1 | 9/2017 |
| WO | WO-2017193107 | A2 | 11/2017 |
| WO | WO-2018035250 | A1 | 2/2018 |
| WO | WO-2018041120 | A1 | 3/2018 |
| WO | WO-2018064352 | A1 | 4/2018 |
| WO | WO-2018064594 | A2 | 4/2018 |
| WO | WO-2018073393 | A2 | 4/2018 |
| WO | WO-2018074979 | A1 | 4/2018 |
| WO | WO-2018129346 | A1 | 7/2018 |
| WO | WO-2018172556 | A1 | 9/2018 |
| WO | WO-2018209712 | A1 | 11/2018 |
| WO | WO-2019094791 | A2 | 5/2019 |
| WO | WO-2019097305 | A2 | 5/2019 |
| WO | WO-2019118516 | A1 | 6/2019 |
| WO | WO-2019161290 | A1 | 8/2019 |
| WO | WO-2019165168 | A1 | 8/2019 |
| WO | WO-2019178421 | A1 | 9/2019 |
| WO | WO-2019195492 | A1 | 10/2019 |
| WO | WO-2019200306 | A1 | 10/2019 |
| WO | WO-2020041120 | A1 | 2/2020 |
| WO | WO-2020055941 | A1 | 3/2020 |
| WO | WO-2020057486 | A1 | 3/2020 |
| WO | WO-2020081613 | A1 | 4/2020 |
| WO | WO-2020084580 | A1 | 4/2020 |
| WO | WO-2020150534 | A2 | 7/2020 |
| WO | WO-2020168122 | A1 | 8/2020 |
| WO | WO-2020168234 | A1 | 8/2020 |
| WO | WO-2020168291 | A1 | 8/2020 |
| WO | WO-2020168300 | A1 | 8/2020 |
| WO | WO-2020236967 | A1 | 11/2020 |
| WO | WO-2021097118 | A1 | 5/2021 |
| WO | WO-2021202559 | A1 | 10/2021 |
| WO | WO-2021202568 | A1 | 10/2021 |
| WO | WO-2021226363 | A1 | 11/2021 |
| WO | WO-2021226369 | A1 | 11/2021 |
| WO | WO-2022056324 | A1 | 3/2022 |
| WO | WO-2022087494 | A1 | 4/2022 |
| WO | WO-2022132765 | A1 | 6/2022 |
| WO | WO-2022159758 | A1 | 7/2022 |
| WO | WO-2022232638 | A2 | 11/2022 |
| WO | WO-2023028348 | A1 | 3/2023 |
| WO | WO-2023097262 | A1 | 6/2023 |
| WO | WO-2023097282 | A1 | 6/2023 |

OTHER PUBLICATIONS

Co-pending U.S. Appl. No. 18/435,779, inventors Thomas; Brian et al., filed Feb. 7, 2024.

Co-pending U.S. Appl. No. 18/668,543, inventors Thomas; Brian C. et al., filed May 20, 2024.

Corley , et al. How RNA-Binding Proteins Interact with RNA: Molecules and Mechanisms. Molecular Cell. 78(1):9-29 (2020).

GenPept Accession No. CAH11307. Version No. CAH11307.1. hypothetical protein lpp0160 [*Legionella pneumophila* str. *Paris*]. Record created Oct. 3, 2004. pp. 1-2. Retrieved Jun. 10, 2024 at URL: https://www.ncbi.nlm.nih.gov/protein/CAH11307.1.

GenPept Accession No. WP_127108862. Version No. WP_127108862.1. type II-B CRISPR-associated RNA-guided endonuclease Cas9/Csx12 [*Legionella* sp. km535]. Record created Jan. 6, 2019. pp. 1-2. Retrieved Jun. 10, 2024 at URL: https://www.ncbi.nlm.nih.gov/protein/WP_127108862.1.

Paix, et al. Precision genome editing using synthesis-dependent repair of Cas9-induced DNA breaks. Proceedings of the National Academy of Sciences of the United States of America 114,50:E10745-E10754 (2017).

Shmakov et al., Diversity and evolution of class 2 CRISPR-Cas systems. Nat Rev. Microbiol. 15(3): 169-182 (2017).

Singh, et al. Protein Engineering Approaches in the Post-Genomic Era. Current Protein and Peptide Science 18:1-11 (2017).

UniProtKB Accession No. A0A3B9GP868. CRISPR-associated endonuclease Cas9. Record created Jan. 16, 2019. p. 1, Retrieved Jun. 10, 2024 at URL: https://www.uniprot.org/uniprotkb/A0A3B9GP86/entry.

U.S. Appl. No. 17/193,173 Notice of Allowance dated Feb. 21, 2024.

U.S. Appl. No. 17/431,135 Office Action dated Jun. 4, 2024.

Xu, Daohua. Tigit Cas9-KO Strategy. GenPharmatech Co, Ltd., Retrieved at URL: https://oss.gempharmatech.com/upload/file/20240324/T012735.Tigit%20Cas9-KO%20%20Strategy-EN.pdf, 11 pages (2019).

Xu, et al. Efficient genome engineering in eukaryotes using Cas9 from *Streptococcus thermophilus*. Cellular and Molecular Life Sciences 72(2):383-399 (2014).

Zhang et al. Propagated Perturbations from a Peripheral Mutation Show Interactions Supporting WW Domain Thermostability. Structure 26(11):1474-1485 (2018).

Zhou, X.M. et al. Intrinsic Expression of Immune Checkpoint Molecule TIGIT Could Help Tumor Growth in vivo by Suppressing the Function of NK and CD8+ T Cells. Front. Immunol. vol. 9, Article 2821: 1-11 (2018).

Altae-Tran et al.: The widespread IS200/IS605 transposon family encodes diverse programmable RNA-guided endonucleases. Science. 374(6563):57-65 doi:10.1126/science.abj6856 (2021).

Andronescu et al. Efficient Parameter Estimation for RNA Secondary Structure Prediction. Bioinformatics 23(13):i19-28 (2007).

Bitard-Feildel, T. et al., Order in Disorder as Observed by the Hydrophobic Cluster Analysis of Protein Sequences, Proteomics, 2018, vol. 18, E1800054, pp. 1-12.

Brinkman et al.: Easy quantitative assessment of genome editing by sequence trace decomposition. Nucleic Acids Research 42(22):e168 , pp. 1-8 doi: 10.1093/nar/gku936 (2014).

Burstein et al.: New CRISPR-Cas systems from uncultivated microbes. Nature. 542(7640):237-241 (2017).

Carugo, O., Amino Acid Composition and Protein Dimension, Protein Science, Oct. 2008, vol. 17, No. 12, pp. 2187-2191.

Co-pending U.S. Appl. No. 18/053,232, inventors Thomas; Brian et al., filed Nov. 7, 2022.

CtSKENNERTON: Mining CRISPRs in Environmental Datasets: Minced. GitHub URL:www.github.com/ctSkennerton/minced [1-4](2019).

Ding et al.: Recent Advances in Genome Editing Using CRISPR/Cas9. Front Plant Sci. 7:703:1-12 doi: 10.3389/fpls.2016.00703 (2016).

Dyson, H.J., Roles of intrinsic disorder in protein-nucleic acid interactions, Mol Biosyst, 2011, vol. 8, No. 1, pp. 97-104.

Fang et al.: CRISPR/Cas9-mediated Genome Editing Technology. Progress in Biochemistry and Biophysics, 40(8):691-702 [with English Machine Translation] (2013).

Gasiunas et al., A catalogue of biochemically diverse CRISPR-Cas9 orthologs. Nat Commun. 11: 5512, pp. 1-10 (2020).

Gasiunas, et al., Cas9-crRNA ribonucleoprotein complex mediates specific DNA cleavage for adaptive immunity in bacteria. Proceedings of the National Academy of Sciences of the United States of America 109:E2579-E2586 (2012).

Goltsman et al.: Compact Cas9d and HEARO enzymes for genome editing discovered from uncultivated microbes. Nat Commun. 13(1):7602:1-11. doi: 10.1038/s41467-022-35257-7 (2022).

Guo et al.: Off-target effects and optimization strategies of CRISPR/Cas9 technology. Progress in Biochemistry and Biophysics, 45(8):798-807 [with English Machine Translation] (2018).

(56) References Cited

OTHER PUBLICATIONS

Harms, M. et al., Analyzing protein structure and function using ancestral gene reconstruction, Current Opinion in Structural Biology, 2010, vol. 20, No. 6, pp. 360-366.
Harrington, Lucas, et al., Programmed DNA Destruction by Miniature CRISPR-Cas14 Enzymes. Science 362(6416):839-842 (2018).
Harris, K.A et al., Large Noncoding RNAs in Bacteria, Microbiol Spectr, 2018, vol. 6, No. 4, pp. 1-18.
Hayashi et al.: Efficient viral delivery of Cas9 into human safe harbor. Scientific Reports 10(1):21474:1-14 doi:10.1038/s41598-020-78450-8 (2020).
Herdewijn: Heterocyclic modifications of oligonucleotides and antisense technology. Antisense & Nucleic Acid Drug Dev 10:297-310 (2000).
Huber et al. Orchestrating High-Throughput Genomic Analysis With Bioconductor. Nat Methods 12(2):115-21 (2015).
Jiang, F., et al., CRISPR—Cas9 Structures and Mechanisms, Annual Reviews Biophys., (2017), 46:505-529.
Jinek, Martin, et al., A programmable dual-RNA-guided DNA endonuclease in adaptive bacterial immunity. Science 337(6096):816-821 (2012).
Kapitonov et al.: ISC, a Novel Group of Bacterial and Archaeal DNA Transposons That Encode Cas9 Homologs. J Bacteriol. 198(5):797-807 doi:10.1128/JB.00783-15 (2015).
Karvelis et al. Methods for Decoding Cas9 Protospacer Adjacent Motif (PAM) Sequences: A Brief Overview. Methods 121-122:3-8 (2017).
Katoh, K. et al., MAFFT Multiple Sequence Alignment Software Version 7: Improvements in Performance and Usability, Molecular Biology and Evolution, 2013, vol. 30, No. 4, pp. 772-780.
Koonin et al. (2017) Diversity, classification and evolution of CRISPR-Cas systems. Current Opinion in Microbiology, 37:67-78 (Year : 2017).
Madshus, I.H . . . Regulation of intracellular pH in eukaryotic cells, Biochemical Journal, 1988, vol. 250, No. 1, pp. 1-8.
Makarova et al. Evolutionary classification of CRISPR-Cas systems: a burst of class 2 and derived variants. Nat Rev Microbiol. 18(2):67-83 (2020).
Mali, Prashant, et al., RNA-Guided Human Genome Engineering Via Cas9. Science 339(6121):823-826 (2013).
Mir et al.: Type II-C CRISPR-Cas9 Biology, Mechanism, and Application. ACS Chem Biol. 13(2):357-365 (2018).
Moon et al.: Recent advances in the CRISPR genome editing tool set. Exp Mol Med. 51(11):1-11 (2019).
Murthy, A.C. et al., "Molecular interactions underlying liquid-liquid phase separation of the FUS low complexity domain", Nat Struct Mol Biol, 2019, vol. 26, No. 7, pp. 637-648.
NCBI GenBank Accession No. HHR99113.1, TPA: type II CRISPR RNA-guided endonuclease Cas9 [Acidobacteria bacterium] [1-2](2020).
NCBI GenBank Accession No. WP_061212298.1, HNH endonuclease [Dermabacter hominis] [1-2](2016).
NCBI GenBank: GBR72910.1—CRISPR-associated protein Csn1 family [Candidatus Termititenax aidoneus], pp. 1-3 (Oct. 31, 2019).
NCBI GenBank: WP_070675185.1—Multispecies: HNH endonuclease [unclassified Rothia (in: high G+C Gram-positive bacteria)], pp. 1-2 (Jan. 20, 2023).
NCBI GenBank: WP_070690139.1—HNH endonuclease [*Rothia* sp. HMSC076D04], pp. 1-3 (Jan. 20, 2023).
NCBI GenBank: WP_070847477.1—HNH endonuclease [*Rothia* sp. HMSC065C03], pp. 1-2 (May 16, 2022).
NCBI Reference Sequence: RMH36335.1, hypothetical protein D66910_06140 [Nitrospirae bacterium], https://www.ncbi.nlm.nih.gov/protein/RMH36335.1/ [1-2] (Published on Oct. 29, 2018).
Nowak et al. Guide RNA engineering for versatile Cas9 functionality. Nucleic Acids Res. 44(20):9555-9564 (2016).
Osorio, D. et al., Peptides: A Package for Data Mining of Antimicrobial Peptides, The R. Journal, 2015, 7(1), 4-14, pp. 1-11.
PCT/US2020/018353 International Search Report and Written Opinion dated Jun. 30, 2020.
PCT/US2020/018432 International Search Report and Written Opinion dated Jun. 30, 2020.
PCT/US2021/024927 International Search Report and Written Opinion dated Jul. 21, 2021.
PCT/US2021/024945 International Search Report and Written Opinion mailed Jul. 20, 2021.
PCT/US2021/031136 International Search Report and Written Opinion dated Aug. 25, 2021.
PCT/US2021/031143 International Search Report and Written Opinion dated Aug. 25, 2021.
PCT/US2022/027124 International Preliminary Report on Patentability dated Nov. 9, 2023.
PCT/US2022/027124 International Search Report and Written Opinion dated Oct. 26, 2022.
PCT/US2022/041755 International Preliminary Report on Patentability dated Mar. 7, 2024.
PCT/US2022/041755 International Search Report and Written Opinion dated Dec. 2, 2022.
PCT/US2022/080411 International Search Report and Written Opinion dated Apr. 19, 2023.
PCT/US2022/080437 International Search Report and Written Opinion dated Feb. 28, 2023.
Price, M.N. et al., Fast Tree2—Approximately Maximum-Likelihood Trees for Large Alignments, PLOS One, 2010, vol. 5, No. 3, e9490, pp. 1-10.
Ran, F. et al., In vivo genome editing using *Staphylococcus aureus* Cas 9, Nature, 2015, vol. 520, pp. 1-18.
Rautela et al.: Efficient genome editing of human natural killer cells by CRISPR RNP. bioRxiv prePrint doi: https://doi.org/10.1101/406934 [1-24] (2018).
Schneider et al. Sequence logos: a new way to display consensus sequences. Nucleic acids research 18(20):6097-6100 (1990).
Shmakov et al., Discovery and Functional Characterization of Diverse Class 2 CRISPR-Cas Systems. Mol Cell 60(3):385-397 (2015).
Shmakov, et al.: Diversity and evolution of class 2 CRISPR-Cas systems. Nature Reviews Microbiology 15(3): 169-182 (2017).
Stamatakis, A., RAxML Version 8: a tool for phylogenetic analysis and post-analysis of large phylogenies, Bioinformatics, 2014, vol. 30, No. 9, pp. 1312-1313.
Tang et al.: Class 2 CRISPR/Cas: an expanding biotechnology toolbox for and beyond genome editing. Cell Biosci. 8:59 doi:10.1186/s13578-018-0255-x [1-13](2018).
Tareen et al.: Logomaker: beautiful sequence logos in Python. Bioinformatics 6(7):2272-2274 (2020).
UniProtKB, [online] Accession No. A0A1F8ZSN4, HNH nuclease domain-containing protein, Dec. 11, 2019, p. 1 [retrieved online Apr. 24, 2024], URL: https://rest.uniprot.org/unisave/A0A1F8ZSN4?format=txt&versions=11.
UniProtKB, [online] Accession No. AA0A3D 5Y812 and HNHc domain-containingprotein, Dec. 11, 2019, p. 1 [retrieved online Apr. 24, 2024], URL: https://rest.uniprot.org/unisave/A0A3D5Y812?format=txt&versions=6.
Uniprotkb/trembl: A0A1F0KNW4 • A0A1F0KNW4_9MICC HNHc domain-containing protein. *Rothia* sp. HMSC066H02, pp. 1-5 [retrieved online Dec. 1, 2022] URL: https://www.uniprot.org/uniprotkb/A0A1F0KNW4/entry (Feb. 15, 2017).
Uniprotkb/trembl: A0A1S1DAD0 • A0A1S1DAD0_9MICC HNH Cas9-type domain-containing protein. *Rothia* sp. HMSC065C03, pp. 1-5 [retrieved online Dec. 1, 2022] URL: https://www.uniprot.org/uniprotkb/A0A1S1DAD0/entry (Apr. 12, 2017).
Uniprotkb/trembl: A1F0PN46 • A0A1F0PN46_9MICC HNH Cas9-type domain-containing protein. *Rothia* sp. HMSC076D04, pp. 1-5 [retrieved online Dec. 1, 2022] URL: https://www.uniprot.org/uniprotkb/A0A1F0PN46/entry (Feb. 15, 2017).
U.S. Appl. No. 17/193,173 Final Office Action dated Apr. 17, 2023.
U.S. Appl. No. 17/193,173 Non-Final Office Action dated Oct. 7, 2022.
U.S. Appl. No. 17/857,923 Advisory Action dated Aug. 8, 2023.
U.S. Appl. No. 17/857,923 Final Office Action dated Jun. 13, 2023.
U.S. Appl. No. 17/857,923 Non-Final Office Action dated Feb. 28, 2023.
U.S. Appl. No. 16/917,837 Office Action dated Aug. 26, 2020.

(56) References Cited

OTHER PUBLICATIONS

U.S. Appl. No. 16/917,838 Office Action dated Jul. 28, 2020.
U.S. Appl. No. 17/431,135 Office Action dated Feb. 16, 2024.
Weinberg, Z. et al, Extraordinary Structured Noncoding RNAs Revealed by Bacterial Metagenome Analysis, Nature 2009, vol. 462, No. 7273, pp. 656-659.
Xiao, N. et la., protr/ProtrWeb: R package and web server for generating various numerical representation schemes of protein sequences, Bioinformatics, 2015, vol. 31, No. 11, pp. 1857-1859.
Yan et al., Functionally diverse type V CRISPR-Cas systems. Science 363: 88-91 (2019).
Yang et al.: New CRISPR-Cas systems discovered. Cell Res. 27(3):313-314 doi:10.1038/cr.2017.21 (2017).
Yang, Z., PAML 4: Phylogenetic Analysis by Maximum Likelihood, Molecular Biology and Evolution, 2007, vol. 24, No. 8, pp. 1586-1591.
Kortleve, D. et al. Orthotopic editing of T-cell receptors. Cell Therapy vol. 3: 949-950 (2019).
NCBI GenBank: OGP48943.1—MAG: hypothetical protein A2022_01700 [Deltaproteobacteria bacterium GWF2_42_12], pp. 1-2 (Oct. 20, 2016).
Co-pending U.S. Appl. No. 19/028,339, inventors Thomas; Brian C. et al., filed Jan. 17, 2025.
Makarova, Kira S. et al. Unification of Cas protein families and a simple scenario for the origin and evolution of CRISPR-Cas systems. Biology Direct 6:38, 1-27 (2011).

*FIG. 25*
J3F280_CAS9_ACTNH_4ogc
J7RUA5_CAS9_STAAU
Q99ZW2_CAS9_SPY
MG15-169
MG15-170
MG15-175
MG15-177
MG15-181
MG15-172
MG15-176
MG15-174
MG15-171
MG15-184
MG15-182
MG15-187
MG15-191
MG15-180
MG15-166
MG15-167
MG15-168
MG15-165
MG15-164
MG15-193
MG15-216
MG15-218
MG15-215
MG15-217
MG15-157
MG15-2
MG15-3
MG15-159
MG15-14
MG15-146
MG15-149
MG15-118
MG15-13
MG15-107
MG15-97
MG15-213
MG15-95
MG15-209
MG15-133
MG15-210
MG15-64
MG15-208
MG15-124
MG15-94
MG15-211
MG15-10
MG15-141
MG15-140
MG15-135
MG15-138
MG15-203
MG15-136
MG15-115
MG15-205
MG15-137
MG15-214
MG15-204
MG15-66
MG15-67
MG15-196
MG15-112
MG15-201
MG15-199
MG15-200
MG15-197
MG15-198
MG15-202
MG15-4
MG15-212
MG15-45
MG15-130
MG15-162
MG15-177
MG15-87
MG15-84 and 4 others (0.003)
MG15-102
MG15-63
MG15-20
MG15-1
MG15-100
MG15-85
MG15-79
MG15-207
MG15-48
MG15-116
MG15-31
MG15-61
MG15-88 and 12 others (0.032)
0.5

MG123-1

MG124-2

MG125-1

MG125-2

MG125-3

MG125-4

MG125-5

MG150-5

MG150-6

MG150-7

MG150-8

MG150-9

MG3-18

MG3-89

MG3-90

MG3-91

MG3-92

MG3-93

MG3-95

MG3-96

MG3-103

MG15-130

MG15-146

MG15-164

MG15-166

MG15-171

MG15-172

MG15-174

MG15-184

MG15-187

MG15-191

MG15-193

MG15-195

MG15-217

MG15-218

MG15-219

MG15-177

ENZYMES WITH RUVC DOMAINS

RELATED APPLICATIONS

This application is related to PCT application no. PCT/US2021/031136, which is incorporated by reference in its entirety herein.

CROSS-REFERENCE

This application is a continuation of International Application No. PCT/US2022/041755, filed on Aug. 29, 2022, which claims the benefit of U.S. Provisional Application Nos: 63/237,791, filed on Aug. 27, 2021; 63/245,629 filed on Sep. 17, 2021; 63/252,956, filed on Oct. 6, 2021; 63/282,909, filed on Nov. 24, 2021; 63/316,895, filed on Mar. 4, 2022; 63/319,681, filed on Mar. 14, 2022; 63/322,944, filed on Mar. 23, 2022; and 63/369,858, filed on Jul. 29, 2022; each of which is incorporated by reference herein in its entirety.

BACKGROUND

Cas enzymes along with their associated Clustered Regularly Interspaced Short Palindromic Repeats (CRISPR) guide ribonucleic acids (RNAs) appear to be a pervasive (~45% of bacteria, ~84% of archaea) component of prokaryotic immune systems, serving to protect such microorganisms against non-self nucleic acids, such as infectious viruses and plasmids by CRISPR-RNA guided nucleic acid cleavage. While the deoxyribonucleic acid (DNA) elements encoding CRISPR RNA elements may be relatively conserved in structure and length, their CRISPR-associated (Cas) proteins are highly diverse, containing a wide variety of nucleic acid-interacting domains. While CRISPR DNA elements have been observed as early as 1987, the programmable endonuclease cleavage ability of CRISPR/Cas complexes has only been recognized relatively recently, leading to the use of recombinant CRISPR/Cas systems in diverse DNA manipulation and gene editing applications.

SEQUENCE LISTING

The instant application contains a Sequence Listing which has been submitted electronically in XML format and is hereby incorporated by reference in its entirety. Said XML copy, created on Feb. 22, 2024, is named 55921-731_301.xml and is 26,079,403 bytes in size.

SUMMARY

In some aspects, the present disclosure provides for a method of disrupting a Beta-2-Microglobulin (B2M) locus in a cell, comprising contacting to the cell (a) an RNA-guided endonuclease; and (b) an engineered guide RNA, wherein the engineered guide RNA is configured to form a complex with the endonuclease and the engineered guide RNA comprises a spacer sequence configured to hybridize to a region of the B2M locus, wherein the region of the B2M locus comprises a targeting sequence having at least 85% identity to at least 18 consecutive nucleotides of any one of SEQ ID NOs: 6387-6468. In some embodiments, the RNA-guided endonuclease is a class 2, type II Cas endonuclease. In some embodiments, the RNA-guided endonuclease comprises a RuvCIII domain comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 6305-6386. In some embodiments, the region of the B2M locus comprises a sequence at least 75%, 80%, or 90% identical to at least 19 of the non-degenerate nucleotides of any one of SEQ ID NOs: 6388, 6399, 6401, 6403, 6410, 6413, 6421, 6446, and 6448.

In some aspects, the present disclosure provides for a method of editing a T Cell Receptor Alpha Constant (TRAC) locus in a cell, comprising contacting to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the TRAC locus, wherein the region of the TRAC locus comprises a targeting sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 consecutive nucleotides of any one of SEQ ID NOs: 6509-6548 or 6805. In some embodiments, the RNA-guided endonuclease is a class 2, type II Cas endonuclease. In some embodiments, the RNA-guided endonuclease comprises a RuvCIII domain comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 6469-6508 or 6804. In some embodiments, the region of the TRAC locus comprises a sequence at least 75%, 80%, or 90% identical to at least 19 of the non-degenerate nucleotides of any one of SEQ ID NOs: 6517, 6520, and 6523.

In some aspects, the present disclosure provides for a method of disrupting a Hypoxanthine Phosphoribosyltransferase 1 (HPRT) locus in a cell, comprising contacting to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the HPRT locus, wherein the region of the HPRT locus comprises a targeting sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 consecutive nucleotides of any one of SEQ ID NOs: 6616-6682. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244. In some embodiments, the RNA-guided endonuclease further comprises an HNH domain. In some embodiments, the engineered guide RNA comprises a sequence having at least 80% identity to any one of SEQ ID NOs: 6549-6615. In some embodiments, the region of the HPRT locus comprises a sequence at least 75%, 80%, or 90% identical to at least 19 of the non-degenerate nucleotides of any one of SEQ ID NOs: 6619, 6634, 6673, 6675, and 6679.

In some aspects, the present disclosure provides for a method of editing a T Cell Receptor Beta Constant 1 or T Cell Receptor Beta Constant 2 (TRBC1/2) locus in a cell, comprising contacting to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the TRBC1/2 locus, wherein the region of the TRBC1/2 locus comprises a targeting sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 consecutive nucleotides of any one of SEQ ID NOs: 6722-6760 or 6782-6802. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244. In some embodiments, the RNA-guided endonuclease further comprises an HNH domain. In some embodiments, the engineered guide RNA comprises a sequence having at least 80% identity to any one of SEQ ID NOs: 6683-6721 and 6761-6781. In some embodiments, the region of the TRBC1/2 locus comprises a sequence at least 75%, 80%, or 90% identical to at least 19 of the non-degenerate nucleotides of any one of SEQ ID NOs: 6734, 6753, 6790, and 6800.

In some aspects, the present disclosure provides for a method of editing an Hydroxyacid Oxidase 1 (HAO1) locus in a cell, comprising contacting to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the HAO1 locus, wherein the region of the HAO1 locus comprises a targeting sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 consecutive nucleotides of any one of SEQ ID NOs: 11802-11820. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242. In some embodiments, the RNA-guided endonuclease further comprises an HNH domain. In some embodiments, the region of the HAO1 locus comprises a sequence at least 75%, 80%, or 90% identical to at least 19 of the non-degenerate nucleotides of any one of SEQ ID NOs: 11806, 11813, 11816, and 11819.

In some aspects, the present disclosure provides for an engineered nuclease system comprising: (a) an RNA-guided endonuclease; and (b) an engineered guide RNA, wherein the engineered guide RNA comprises (i) a 2'-O-methyl nucleotide; (ii) a 2'-fluoro nucleotide; or (iii) a phosphorothioate bond; wherein the RNA-guided endonuclease has at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 421-431 or a variant thereof. In some embodiments, the RNA-guided endonuclease comprises a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 421.

In some aspects, the present disclosure provides for an engineered nuclease system comprising: (a) an endonuclease having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 421-431 or a variant thereof; and (b) an engineered guide RNA, wherein the engineered guide RNA is configured to form a complex with the endonuclease and the engineered guide RNA comprises a spacer sequence configured to hybridize to a target nucleic acid sequence, wherein the system has reduced immunogenicity when administered to a human subject compared to an equivalent system comprising a Cas9 enzyme. In some embodiments, the Cas9 enzyme is an SpCas9 enzyme. In some embodiments, the immunogenicity is antibody immunogenicity. In some embodiments, the engineered guide RNA comprises a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of any one of SEQ ID NOs: 5466-5467 and 11160-11162. In some embodiments, the engineered nuclease has at least about 75% sequence identity at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 421 or 423 or a variant thereof.

In some aspects, the present disclosure provides for a method of editing a locus in a cell, comprising contacting to the cell: (a) an RNA-guided endonuclease or a nucleic acid encoding the RNA-guided endonuclease; and (b) an engineered guide RNA, wherein the engineered guide RNA is configured to form a complex with the RNA-guided endonuclease and the engineered guide RNA comprises a spacer sequence configured to hybridize to a region of the locus; wherein the cell is a peripheral blood mononuclear cell (PBMC), a hematopoietic stem cell (HSC), or an induced pluripotent stem cell (iPSC). In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the RNA-guided endonuclease has at least about 75% sequence identity at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 421 or a variant thereof. In some embodiments, the engineered guide RNA comprises a sequence at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 6804, 6806, and 6808. In some embodiments, the nucleic acid encoding the RNA-guided endonuclease comprises a sequence comprising at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 6803 or a variant thereof. In some embodiments, the region of the locus comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 nucleotides of any one of SEQ ID NOs: 6805, 6807, and 6809.

In some aspects, the present disclosure provides for a method of editing a CD2 Molecule (CD2) locus in a cell, comprising contacting to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the CD2 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 6853-6894; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to the non-degenerate nucleotides of any one of SEQ ID NOs: 6811-6852. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244, or a variant thereof. In some embodiments, the RNA-guided endonuclease further comprises an HNH domain. In some embodiments, the RNA-guided endonuclease comprises a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 421-431. In some embodiments, the RNA-guided endonuclease comprises a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 421, or a variant thereof. In some embodiments, the engineered guide RNA comprises a sequence at least about 80%, at least about 85%, at least about 90%, at least about 91%, at least about 92%, at least about 93%, at least about 94%, at least about 95%, at least about 96%, at least about 97%, at least about 98%, or at least about 99% identical to the non-degenerate nucleotides of any one of SEQ ID NOs: 6813, 6841, 6843-6847, 6852, or 6852. In some embodiments, the engineered guide RNA further comprises a pattern of nucleotide modifications recited in any of the guide RNAs recited in Table 6A. In some embodiments, the engineered guide RNA comprises or is configured to hybridize to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 consecutive nucleotides of any one of SEQ ID NOs: 6855, 6883, 6885-6889, 6892, or 6984.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 6811-6852. In some embodiments, the RNA molecule further comprises a pattern of nucleotide modifications recited in any of the guide RNAs recited in Table 6A.

In some aspects, the present disclosure provides for a method of editing a CD5 Molecule (CD5) locus in a cell comprising contacting to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the CD5 locus, wherein the engineered guide RNA comprises or is configured to hybridize to a sequence having at least 18-22 consecutive nucleotide complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID Nos: 6959-7022; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity the non-degenerate nucleotides of any one of SEQ ID NOs: 5466 or 6895-6958. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244, or a variant thereof. In some embodiments, the RNA-guided endonuclease further comprises an HNH domain. In some embodiments, the RNA-guided endonuclease comprises an endonuclease comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 421-431 or a variant thereof. In some embodiments, the RNA-guided endonuclease comprises a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 421. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity the non-degenerate nucleotides of any one of SEQ ID NOs: 6897, 6904, 6906, 6911, 6928, 6930, 6932, 6934, 6938, 6945, 6950, 6952, and 6958. In some embodiments, the engineered guide RNA further comprises a pattern of nucleotide modification recited in any of the guide RNAs recited in Table 7A. In some embodiments, the engineered guide RNA is configured to hybridize to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to at least 18 consecutive nucleotides of any one of SEQ ID NOs: 6961, 6968, 6970, 6975, 6992, 6994, 6996, 6998, 7002, 7009, 7014, 7016, and 7022.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 6895-6958. In some embodiments, the RNA molecule further comprises a pattern of nucleotide modifications recited in any of the guide RNAs recited in Table 7A.

In some aspects, the present disclosure provides for a method of editing an RNA locus in a cell, comprising contacting to the cell: (a) an RNA-guided endonuclease comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242 or SEQ ID NO: 2244, or a variant thereof; and (b) an engineered guide RNA, wherein the engineered guide RNA is configured to form a complex with the endonuclease and the engineered guide RNA comprises a spacer sequence configured to hybridize to a region of the RNA locus, wherein the RNA locus does not comprise bacterial or microbial RNA. In some embodiments, the guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466 or SEQ ID NO: 5539.

In some aspects, the present disclosure provides for a method of disrupting a Fas Cell Surface Death Receptor (FAS) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the human FAS locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7057-7090; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7023-7056. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises or is configured to hybridize to a sequence having at least 80% identity to at least 18 consecutive nucleotides of any one of SEQ ID NOs: 7059, 7061, 7069, 7070, 7076, 7080, 7083, 7084, 7085, or 7088. In some embodiments, the RNA-guided endonuclease comprises a sequence at least 75%, 80%, or 90% identical to SEQ ID NO: 421, or a variant thereof. In some embodiments, the guide RNA comprises a sequence having at least 80% identity to any one of SEQ ID NOs: 7025, 7027, 7035, 7036, 7042, 7046, 7049-7051, or 7054. In some embodiments, the guide RNA further comprises a pattern of nucleotide modifications recited in any of the guide RNAs recited in Table 8.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7023-7056. In some embodiments, the RNA molecule further comprises a pattern of nucleotide modifications recited in any of the guide RNAs recited in Table 8.

In some aspects, the present disclosure provides for a method of disrupting a Programmed Cell Death 1 (PD-1) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the human PD-1 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7129-7166; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7091-7128. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises or is configured to hybridize to a sequence having at least 80% identity to at least 18 consecutive nucleotides of any one of SEQ ID NOs: 7135, 7137, 7146, 7149, 7152, 7156, 7160, 7161, 7164, 7165, or 7166. In some embodiments, the RNA-guided endonuclease comprises a sequence at least 75%, 80%, or 90% identical to SEQ ID NO: 421, or a variant thereof. In some embodiments, the guide RNA comprises a sequence having at least 80% identity to any one of SEQ ID NOs: 7097, 7099, 7108, 7111, 7114, 7118, 7122, 7123, 7126, 7127, or 7128. In some embodiments, the guide RNA further comprises a pattern of nucleotide modifications recited in any of the guide RNAs recited in Table 9.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7091-7128. In some embodiments, the RNA molecule further comprises a pattern of nucleotide modifications recited in any of the guide RNAs recited in Table 9.

In some aspects, the present disclosure provides for a method of disrupting an human Rosa26 (hRosa26) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the hRosa26 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7199-7230; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7167-7198. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises or is configured to hybridize to a sequence having at least 80% identity to at least 18 consecutive nucleotides of any one of SEQ ID NOs: 7205-7206, 7215, 7220, 7223, or 7225. In some embodiments, the RNA-guided endonuclease comprises a sequence at least 75%, 80%, or 90% identical to SEQ ID NO: 421, or a variant thereof. In some embodiments, the guide RNA comprises a sequence having at least 80% identity to any one of SEQ ID NOs: 7173, 7174, 7183, 7188, 7191, or 7193. In some embodiments, the guide RNA further comprises a pattern of nucleotide modifications recited in any of the guide RNAs recited in Table 10.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7167-7198. In some embodiments, the RNA molecule further comprises a pattern of nucleotide modifications recited in any of the guide RNAs recited in Table 10.

In some aspects, the present disclosure provides for a method of disrupting an T Cell Receptor Alpha Constant (TRAC) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the TRAC locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7235-7238, 7248-7256, 7270, or 7278-7284; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7231-7234, 7239-7247, 7269, or 7271-7277. In some embodiments, the RNA-guided endonuclease is a class 2, type II Cas endonuclease. In some embodiments, the RNA-guided endonuclease comprises a sequence at least 75%, 80%, or 90% identical to SEQ ID NO: 1512, 1756, 11711-11713, or a variant thereof. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5473, 5475, 11145, 11714, or 11715. In some embodiments, the engineered guide RNA comprises or is configured to hybridize to a sequence having at least 80% identity to at least 18 consecutive nucleotides of any one of SEQ ID NOs: 7235-7238, 7248-7256, 7270, or 7278-7284. In some embodiments, the guide RNA comprises a sequence having at least 80% identity to any one of SEQ ID NOs: 7231-7234, 7239-7244, 7269, or 7271-7277. In some embodiments, the engineered guide RNA further comprises a pattern of nucleotide modifications recited in any of the guide RNAs recited in Table 11.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7231-7234, 7239-7247, 7269, or 7271-7277. In some embodiments, the RNA molecule further comprises a pattern of nucleotide modifications recited in any of the guide RNAs recited in Table 11.

In some aspects, the present disclosure provides for a method of disrupting an Adeno-Associated Virus Integration Site 1 (AAVS1) locus in a cell, comprising introducing to the cell: (a) a class 2, type II Cas endonuclease; and (b) an engineered guide RNA, wherein the engineered guide RNA is configured to form a complex with the endonuclease and the engineered guide RNA comprises a spacer sequence configured to hybridize to a region of the AAVS1 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7261-7264 or 7267-7268; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7257-7260 or 7265-7266. In some embodiments, the RNA-guided endonuclease is a class 2, type II Cas endonuclease. In some embodiments, the RNA-guided endonuclease comprises a sequence at least 75%, 80%, or 90% identical to SEQ ID NO: 1756 or 11711, or a variant thereof. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5475 or 11715. In some embodiments, the engineered guide RNA comprises or is configured to hybridize to a sequence having at least 80% identity to at least 18 consecutive nucleotides of any one of SEQ ID NOs: 7261-7263 or 7267-7268. In some embodiments, the guide RNA comprises a sequence having at least 80% identity to any one of SEQ ID NOs: 7257-7260 or 7265-7266. In some embodiments, the engineered guide RNA further comprises a pattern of nucleotide modifications recited in any of the guide RNAs recited in Table 12.

In some aspects, the present disclosure provides for an isolated RNA molecule comprising a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 7257-7260 or 7265-7266. In some embodiments, the RNA molecule further comprises a pattern of nucleotide modifications recited in any of the guide RNAs recited in Table 12.

In some aspects, the present disclosure provides for a method of disrupting an Hydroxyacid Oxidase 1 (HAO-1) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the HAO-1 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11773-11793. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises or is configured to hybridize to a sequence having at least 80% identity to at least 18 consecutive nucleotides of any one of SEQ ID NOs: 11773, 11780, 11786, or 11787. In some embodiments, the RNA-guided endonuclease comprises a sequence at least 75%, 80%, or 90% identical to SEQ ID NO: 421, or a variant thereof.

In some aspects, the present disclosure provides for an isolated RNA molecule comprising a spacer sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11773-11793 and a scaffold sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 5466.

In some aspects, the present disclosure provides for a method of disrupting a human G Protein-Coupled Receptor 146 (GPR146) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the GPR146 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11406-11437; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11374-11405. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises or is configured to hybridize to a sequence having at least 80% identity to at least 18 consecutive nucleotides of SEQ ID NO: 11425. In some embodiments, the RNA-guided endonuclease comprises a sequence at least 75%, 80%, or 90% identical to SEQ ID NO: 421, or a variant thereof. In some embodiments, the guide RNA comprises a sequence having at least 80% identity to SEQ ID NO: 11393. In some embodiments, the engineered guide RNA further comprises a pattern of nucleotide modifications recited in any of the guide RNAs recited in Table 15.

In some aspects, the present disclosure provides for an isolated RNA molecule comprising a spacer sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11374-11405. In some embodiments, the RNA molecule further comprises a pattern of nucleotide modifications recited in any of the guide RNAs recited in Table 15.

In some aspects, the present disclosure provides for a method of disrupting a mouse G Protein-Coupled Receptor 146 (GPR146) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the GPR146 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11473-11507; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11438-11472. In some embodiments, the RNA-guided endonuclease is a class 2, type II Cas endonuclease. In some embodiments, the RNA-guided endonuclease comprises a RuvCIII domain comprising a sequence having at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to SEQ ID NO: 2242, or a variant thereof. In some embodiments, the RNA-guided endonuclease further comprises an HNH domain. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 5466. In some embodiments, the engineered guide RNA comprises or is configured to hybridize to a sequence having at least 80% identity to at least 18 consecutive nucleotides of any one of SEQ ID NOs: 11482, 11488, or 11490. In some embodiments, the RNA-guided endonuclease comprises a sequence at least 75%, 80%, or 90% identical to SEQ ID NO: 421, or a variant thereof. In some embodiments, the guide RNA comprises a sequence having at least 80% identity to SEQ ID NO: 11447, 11453, or 11455. In some embodiments, the engineered guide RNA further comprises a pattern of nucleotide modifications recited in any of the guide RNAs recited in Table 16.

In some aspects, the present disclosure provides for an isolated RNA molecule comprising a spacer sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11438-11472. In some embodiments, the RNA molecule further comprises a pattern of nucleotide modifications recited in any of the guide RNAs recited in Table 16.

In some aspects, the present disclosure provides for a method of disrupting a T Cell Receptor Alpha Constant (TRAC) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the TRAC locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11516-11517; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11514-11515. In some embodiments, the RNA-guided endonuclease is a class 2, type II Cas endonuclease. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 11153. In some embodiments, the engineered guide RNA comprises or is configured to hybridize to a sequence having at least 80% identity to at least 18 consecutive nucleotides of any one of SEQ ID NOs: 11516. In some embodiments, the RNA-guided endonuclease comprises a sequence at least 75%, 80%, or 90% identical to SEQ ID NO: 11716, or a variant thereof. In some embodiments, the guide RNA comprises a sequence having at least 80% identity to SEQ ID NO: 11514. In some embodiments, the engineered guide RNA further comprises a pattern of nucleotide modifications recited in any of the guide RNAs recited in Table 17.

In some aspects, the present disclosure provides for an isolated RNA molecule comprising a spacer sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11514-11515. In some embodiments, the RNA molecule further comprises a pattern of nucleotide modifications recited in any of the guide RNAs recited in Table 17.

In some aspects, the present disclosure provides for a method of disrupting an Adeno-Associated Virus Integration Site 1 (AAVS1) locus in a cell, comprising introducing to the cell: (a) an RNA-guided endonuclease; and (b) an engineered guide RNA, wherein the engineered guide RNA is configured to form a complex with the endonuclease and the engineered guide RNA comprises a spacer sequence configured to hybridize to a region of the AAVS1 locus, wherein the engineered guide RNA comprises or is configured to hybridize to a sequence having at least 18-22 consecutive nucleotides complementary to a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11511-11513; or wherein the engineered guide RNA comprises a nucleotide sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11508-11510. In some embodiments, the RNA-guided endonuclease is a class 2, type II Cas endonuclease. In some embodiments, the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of SEQ ID NO: 11717. In some embodiments, the engineered guide RNA comprises or is configured to hybridize to a sequence having at least 80% identity to at least 18 consecutive nucleotides of SEQ ID NO: 11511. In some embodiments, the RNA-guided endonuclease comprises a sequence at least 75%, 80%, or 90% identical to SEQ ID NO: 914, or a variant thereof. In some embodiments, the guide RNA comprises a sequence having at least 80% identity to SEQ ID NO: 11508. In some embodiments, the engineered guide RNA further comprises a pattern of nucleotide modifications recited in any of the guide RNAs recited in Table 17.

In some aspects, the present disclosure provides for an isolated RNA molecule comprising a spacer sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any one of SEQ ID NOs: 11508-11510. In some embodiments, the RNA molecule further comprises a pattern of nucleotide modifications recited in any of the guide RNAs recited in Table 17.

In some aspects, the present disclosure provides for an engineered nuclease system comprising: (a) an endonuclease having at least at least about 80%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% sequence identity to a PI domain of any of the Cas effector protein sequences described herein, or a variant thereof; and (b) an engineered guide RNA, wherein the engineered guide RNA is configured to form a complex with the endonuclease and the engineered guide RNA comprises a spacer sequence configured to hybridize to a target nucleic acid sequence, wherein the engineered guide RNA comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to non-degenerate nucleotides of any of the sgRNA sequences described herein. In some embodiments, the endonuclease further comprises a RuvCIII domain or a HNH domain having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to RuvCIII domains or HNH domains of any of the Cas effector nucleases described herein. In some embodiments, the endonuclease is configured to have selectivity for any of the PAM sequences described herein. In some embodiments, the endonuclease further comprises a sequence having at least about 80%, at least about 85%, at least about 90%, at least about 91%, at least about 92%, at least about 93%, at least about 94%, at least about 95%, at least about 96%, at least about 97%, at least about 98%, at least about 99%, or 100% sequence identity to any of the Cas effector sequences described herein.

In some aspects, the present disclosure provides for use of any of the methods described herein for disrupting a B2M locus in a cell.

In some aspects, the present disclosure provides for use of any of the methods described herein or any of the RNA molecules described herein for disrupting a TRAC locus in a cell.

In some aspects, the present disclosure provides for use of any of the methods described herein for disrupting an HPRT locus in a cell.

In some aspects, the present disclosure provides for use of any of the methods described herein for disrupting a TRBC1/2 locus in a cell.

In some aspects, the present disclosure provides for use of any of the methods described herein or any of the RNA molecules described herein for disrupting an HAO-1 locus in a cell.

In some aspects, the present disclosure provides for use of any of the methods described herein or any of the RNA molecules described herein for disrupting a CD2 locus in a cell.

In some aspects, the present disclosure provides for use of any of the methods described herein or any of the RNA molecules described herein for disrupting a CD5 locus in a cell.

In some aspects, the present disclosure provides for use of any of the methods described herein or any of the RNA molecules described herein for disrupting a FAS locus in a cell.

In some aspects, the present disclosure provides for use of any of the methods described herein or any of the RNA molecules described herein for disrupting a PD-1 locus in a cell.

In some aspects, the present disclosure provides for use of any of the methods described herein or any of the RNA molecules described herein for disrupting an hRosa26 locus in a cell.

In some aspects, the present disclosure provides for use of any of the methods described herein or any of the RNA molecules described herein for disrupting an AAVS1 locus in a cell.

In some aspects, the present disclosure provides for use of any of the methods described herein or any of the RNA molecules described herein for disrupting a GPR146 locus in a cell.

In some aspects, the present disclosure provides for an engineered nuclease system, comprising: (a) an endonuclease comprising a RuvC_III domain and an HNH domain, wherein the endonuclease is derived from an uncultivated microorganism, wherein the endonuclease is a class 2, type II Cas endonuclease; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease. In some embodiments, the RuvC_III domain comprises a sequence with at least 70%, at least 75%, at least 80%, at least 85%, at least 88%, at least 90%, at least 92%, at least 95%, or at least 98% sequence identity to any one of SEQ ID NOs: 1827-3637.

In some aspects, the present disclosure provides for an engineered nuclease system comprising: (a) an endonuclease comprising a RuvC_III domain having at least 70%, at least 75%, at least 80%, at least 85%, at least 88%, at least 90%, at least 92%, at least 95%, or at least 98% sequence identity to any one of SEQ ID NOs: 1827-3637; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some aspects, the present disclosure provides for an engineered nuclease system comprising: (a) an endonuclease configured to bind to a protospacer adjacent motif (PAM) sequence comprising SEQ ID NOs: 5512-5537, wherein the endonuclease is a class 2, type II Cas endonuclease; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some embodiments, the endonuclease is derived from an uncultivated microorganism. In some embodiments, the endonuclease has not been engineered to bind to a different PAM sequence. In some embodiments, the endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 5476-5511 and SEQ ID NO: 5538.

In some aspects, the present disclosure provides for an engineered nuclease system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80% sequence identity to about 60 to 90 consecutive nucleotides selected from any one of SEQ ID NOs: 5476-5511 and SEQ ID NO: 5538; and (b) a class 2, type II Cas endonuclease configured to bind to the engineered guide ribonucleic acid. In some embodiments, the endonuclease is configured to bind to a protospacer adjacent motif (PAM) sequence selected from the group comprising SEQ ID NOs: 5512-5537.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence.

In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of the endonuclease. In some embodiments, the NLS comprises a sequence selected from SEQ ID NOs: 5597-5612.

In some embodiments, the engineered nuclease system further comprises a single- or double-stranded DNA repair template comprising from 5' to 3': a first homology arm comprising a sequence of at least 20 nucleotides 5' to the target deoxyribonucleic acid sequence, a synthetic DNA sequence of at least 10 nucleotides, and a second homology arm comprising a sequence of at least 20 nucleotides 3' to the target sequence. In some embodiments, the first or second homology arm comprises a sequence of at least 40, 80, 120, 150, 200, 300, 500, or 1,000 nucleotides.

In some embodiments, the system further comprises a source of Mg2+.

In some embodiments, the endonuclease and the tracr ribonucleic acid sequence are derived from distinct bacterial species within a same phylum. In some embodiments, the endonuclease is derived from a bacterium belonging to a genus Dermabacter. In some embodiments, the endonuclease is derived from a bacterium belonging to Phylum Verrucomicrobia, Phylum Candidatus Peregrinibacteria, or Phylum Candidatus Melainabacteria. In some embodiments, the endonuclease is derived from a bacterium comprising a 16S rRNA gene having at least 90% identity to any one of SEQ ID NOs: 5592-5595.

In some embodiments, the HNH domain comprises a sequence with at least 70% or at least 80% identity to any one of SEQ ID NOs: 5638-5460. In some embodiments, the endonuclease comprises SEQ ID NOs: 1-1826 or a variant thereof having at least 55% identity thereto. In some embodiments, the endonuclease comprises a sequence at least 70%, 80%, or 90% identical to a sequence selected from the group consisting of SEQ ID NOs: 1827-1830 or SEQ ID NOs: 1827-2140.

In some embodiments, the endonuclease comprises a sequence at least 70%, 80%, or 90% identical to a sequence selected from the group consisting of SEQ ID NOs: 3638-3641 or SEQ ID NOs: 3638-3954. In some embodiments, the endonuclease comprises at least 1, at least 2, at least 3, at least 4, or at least 5 peptide motifs selected from the group consisting of SEQ ID NOs: 5615-5632. In some embodiments, the endonuclease comprises a sequence at least 70%, 80%, or 90% identical to a sequence selected from the group consisting of SEQ ID NOs: 1-4 or SEQ ID NOs: 1-319.

In some embodiments, the guide RNA structure comprises a sequence at least 70%, 80%, or 90% identical to a sequence selected from the group consisting of SEQ ID NOs: 5461-5464, SEQ ID NOs: 5476-5479, or SEQ ID NOs: 5476-5489. In some embodiments, the guide RNA structure comprises an RNA sequence predicted to comprise a hairpin consisting of a stem and a loop, wherein the stem comprises at least 10, at least 12 or at least 14 base-paired ribonucleotides, and an asymmetric bulge within 4 base pairs of the loop.

In some embodiments, the endonuclease is configured to bind to a PAM comprising a sequence selected from the group consisting of SEQ ID NOs: 5512-5515 or SEQ ID NOs: 5527-5530.

In some embodiments: (a) the endonuclease comprises a sequence at least 70%, at least 80%, or at least 90% identical to SEQ ID NO: 1827; (b) the guide RNA structure comprises a sequence at least 70%, at least 80%, or at least 90% identical to at least one of SEQ ID NO: 5461 or SEQ ID NO: 5476; and (c) the endonuclease is configured to bind to a PAM comprising SEQ ID NO: 5512 or SEQ ID NO: 5527. In some embodiments: (a) the endonuclease comprises a sequence at least 70%, at least 80%, or at least 90% identical to SEQ ID NO: 1828; (b) the guide RNA structure comprises a sequence at least 70%, at least 80%, or at least 90% identical to at least one of SEQ ID NO: 5462 or SEQ ID NO: 5477; and (c) the endonuclease is configured to bind to a PAM comprising SEQ ID NO: 5513 or SEQ ID NO: 5528. In some embodiments: (a) the endonuclease comprises a sequence at least 70%, at least 80%, or at least 90% identical to SEQ ID NO: 1829; (b) the guide RNA structure comprises a sequence at least 70%, at least 80%, or at least 90% identical to at least one of SEQ ID NO: 5463 or SEQ ID NO: 5478; and (c) the endonuclease is configured to bind to a PAM comprising SEQ ID NO: 5514 or SEQ ID NO: 5529. In some embodiments: (a) the endonuclease comprises a sequence at least 70%, at least 80%, or at least 90% identical to SEQ ID NO: 1830; (b) the guide RNA structure comprises a sequence at least 70%, at least 80%, or at least 90% identical to at least one of SEQ ID NO: 5464 or SEQ ID NO: 5479; and (c) the endonuclease is configured to bind to a PAM comprising SEQ ID NO: 5515 or SEQ ID NO: 5530.

In some embodiments, the endonuclease comprises a sequence at least 70%, 80%, or 90% identical to a sequence selected from the group consisting of SEQ ID NOs: 2141-2142 or SEQ ID NOs: 2141-2241. In some embodiments, the endonuclease comprises a sequence at least 70%, 80%, or 90% identical to a sequence selected from the group consisting of SEQ ID NOs: 3955-3956 or SEQ ID NOs: 3955-4055. In some embodiments, the endonuclease comprises at least 1, at least 2, at least 3, at least 4, or at least 5 peptide motifs selected from the group consisting of SEQ ID NOs: 5632-5638. In some embodiments, the endonuclease comprises a sequence at least 70%, 80%, or 90% identical to a sequence selected from the group consisting of SEQ ID NOs: 320-321 or SEQ ID NOs: 320-420. In some embodiments, the guide RNA structure comprises a sequence at least 70%, 80%, or 90% identical to a sequence selected from the group consisting of SEQ ID NO: 5465, SEQ ID NOs: 5490-5491 or SEQ ID NOs: 5490-5494. In some embodiments, the guide RNA structure comprises a tracr ribonucleic acid sequence comprising a hairpin comprising at least 8, at least 10, or at least 12 base-paired ribonucleotides. In some embodiments, the endonuclease is configured to bind to a PAM comprising a sequence selected from the group consisting of SEQ ID NOs: 5516 and SEQ ID NOs: 5531. In some embodiments: (a) the endonuclease comprises a sequence at least 70%, 80%, or 90% identical to SEQ ID NO: 2141; (b) the guide RNA structure comprises a sequence at least 70%, 80%, or 90% identical to SEQ ID NO: 5490; and (c) the endonuclease is configured to binding to a PAM comprising SEQ ID NO: 5531. In some embodiments: (a) the endonuclease comprises a sequence at least 70%, 80%, or 90% identical to SEQ ID NO: 2142; (b) the guide RNA structure comprises a sequence at least 70%, 80%, or 90% identical to SEQ ID NO: 5465 or SEQ ID NO: 5491; and (c) the endonuclease is configured to binding to a PAM comprising SEQ ID NO: 5516.

In some embodiments, the endonuclease comprises a sequence at least 70%, 80%, or 90% identical to a sequence selected from the group consisting of SEQ ID NOs: 2245-2246. In some embodiments, the endonuclease comprises a sequence at least 70%, 80%, or 90% identical to a sequence selected from the group consisting of SEQ ID NOs: 4059-4060. In some embodiments, the endonuclease comprises at least 1, at least 2, at least 3, at least 4, or at least 5 peptide motifs selected from the group consisting of SEQ ID NOs: 5639-5648. In some embodiments, the endonuclease comprises a sequence at least 70%, 80%, or 90% identical to a sequence selected from the group consisting of SEQ ID NOs: 424-425. In some embodiments, the guide RNA structure comprises a sequence at least 70%, 80%, or 90% identical to a sequence selected from the group consisting of SEQ ID NOs: 5498-5499 and SEQ ID NO: 5539. In some embodiments, the guide RNA structure comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin.

In some embodiments, the endonuclease comprises a sequence at least 70%, 80%, or 90% identical to a sequence selected from the group consisting of SEQ ID NOs: 2242-2244 or SEQ ID NOs: 2247-2249. In some embodiments, the endonuclease comprises a sequence at least 70%, 80%, or 90% identical to a sequence selected from the group consisting of SEQ ID NOs: 4056-4058 and SEQ ID NOs 4061-4063. In some embodiments, the endonuclease comprises at least 1, at least 2, at least 3, at least 4, or at least 5 peptide motifs selected from the group consisting of SEQ ID NOs: 5639-5648. In some embodiments, the endonuclease comprises a sequence at least 70%, 80%, or 90% identical to a sequence selected from the group consisting of SEQ ID NOs: 421-423 or SEQ ID NOs: 426-428. In some embodiments, the guide RNA structure comprises a sequence at least 70%, 80%, or 90% identical to a sequence selected from the group consisting of SEQ ID NOs: 5466-5467, SEQ ID NOs: 5495-5497, SEQ ID NO: 5500-5502, and SEQ ID NO: 5539. In some embodiments, the guide RNA structure comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin. In some embodiments, the endonuclease is configured to binding to a PAM comprising a sequence selected from the group consisting of SEQ ID NOs: 5517-5518 or SEQ ID NOs: 5532-5534. In some embodiments: (a) the endonuclease comprises a sequence at least 70%, 80%, or 90% identical to SEQ ID NO: 2247; (b) the guide RNA structure comprises a sequence at least 70%, 80%, or 90% identical to SEQ ID NO: 5500; and (c) the endonuclease is configured to binding to a PAM comprising SEQ ID NO: 5517 or SEQ ID NO: 5532. In some embodiments: (a) the endonuclease comprises a sequence at least 70%, 80%, or 90% identical to SEQ ID NO: 2248; (b) the guide RNA structure comprises a sequence at least 70%, 80%, or 90% identical to SEQ ID NO: 5501; and (c) the endonuclease is configured to binding to a PAM comprising SEQ ID NO: 5518 or SEQ ID NOs: 5533. In some embodiments: (a) the endonuclease comprises a sequence at least 70%, 80%, or 90% identical to SEQ ID NO: 2249; (b) the guide RNA structure comprises a sequence at least 70%, 80%, or 90% identical to SEQ ID NO: 5502; and (c) the endonuclease is configured to binding to a PAM comprising SEQ ID NO: 5534.

In some embodiments, the endonuclease comprises a sequence at least 70%, 80%, or 90% identical to a sequence selected from the group consisting of SEQ ID NO: 2253 or SEQ ID NOs: 2253-2481. In some embodiments, the endonuclease comprises a sequence at least 70%, 80%, or 90% identical to a sequence selected from the group consisting of SEQ ID NO: 4067 or SEQ ID NOs: 4067-4295. In some embodiments, the endonuclease comprises a peptide motif according to SEQ ID NO: 5649. In some embodiments, the endonuclease comprises a sequence at least 70%, 80%, or 90% identical to a sequence selected from the group consisting of SEQ ID NO: 432 or SEQ ID NOs: 432-660. In some embodiments, the guide RNA structure comprises a sequence at least 70%, 80%, or 90% identical to a sequence selected from the group consisting of SEQ ID NO: 5468 or SEQ ID NO: 5503. In some embodiments, the endonuclease is configured to binding to a PAM comprising a sequence selected from the group consisting of SEQ ID NOs: 5519. In some embodiments: (a) the endonuclease comprises a sequence at least 70%, 80%, or 90% identical to SEQ ID NO: 2253; (b) the guide RNA structure comprises a sequence at least 70%, 80%, or 90% identical to SEQ ID NO: 5468 or SEQ ID NO: 5503; and (c) the endonuclease is configured to binding to a PAM comprising SEQ ID NO: 5519.

In some embodiments, the endonuclease comprises a sequence at least 70%, 80%, or 90% identical to a sequence selected from the group consisting of SEQ ID NOs: 2482-2489. In some embodiments, the endonuclease comprises a sequence at least 70%, 80%, or 90% identical to a sequence selected from the group consisting of SEQ ID NOs: 4296-4303. In some embodiments, the endonuclease comprises a sequence at least 70%, 80%, or 90% identical to a sequence selected from the group consisting of or SEQ ID NOs: 661-668. In some embodiments, the endonuclease comprises a sequence at least 70%, 80%, or 90% identical to a sequence selected from the group consisting of or SEQ ID NOs: 2490-2498. In some embodiments, the endonuclease comprises a sequence at least 70%, 80%, or 90% identical to a sequence selected from the group consisting of SEQ ID NOs: 4304-4312. In some embodiments, the endonuclease comprises a sequence at least 70%, 80%, or 90% identical to a sequence selected from the group consisting of SEQ ID NOs: 669-677. In some embodiments, the guide RNA structure comprises a sequence at least 70%, 80%, or 90% identical to a sequence selected from the group consisting of SEQ ID NO: 5504.

In some embodiments, the endonuclease comprises a sequence at least 70%, 80%, or 90% identical to a sequence selected from the group consisting of SEQ ID NO: 2499 or SEQ ID NOs: 2499-2750. In some embodiments, the endonuclease comprises a sequence at least 70%, 80%, or 90% identical to a sequence selected from the group consisting of SEQ ID NO: 4313 or SEQ ID NOs: 4313-4564. In some embodiments, the endonuclease comprises at least 1, at least 2, at least 3, at least 4, or at least 5 peptide motifs selected from the group consisting of SEQ ID NOs: 5650-5667. In some embodiments, the endonuclease comprises a sequence at least 70%, 80%, or 90% identical to a sequence selected from the group consisting of SEQ ID NO: 678 or SEQ ID NOs: 678-929. In some embodiments, the guide RNA structure comprises a sequence at least 70%, 80%, or 90% identical to SEQ ID NO: 5469 or SEQ ID NO: 5505. In some embodiments, the endonuclease is configured to binding to a PAM comprising SEQ ID NOs: 5520 or SEQ ID NOs: 5535. In some embodiments: (a) the endonuclease comprises a sequence at least 70%, 80%, or 90% identical to SEQ ID NO: 2499; (b) the guide RNA structure comprises a sequence at least 70%, 80%, or 90% identical to SEQ ID NO: 5469 or SEQ ID NO: 5505; and (c) the endonuclease is configured to binding to a PAM comprising SEQ ID NO: 5520 or SEQ ID NO: 5535.

In some embodiments, the endonuclease comprises a sequence at least 70%, 80%, or 90% identical to a sequence selected from the group consisting of SEQ ID NO: 2751 or SEQ ID NOs: 2751-2913. In some embodiments, the endonuclease comprises a sequence at least 70%, 80%, or 90% identical to a sequence selected from the group consisting of SEQ ID NO: 4565 or SEQ ID NOs: 4565-4727. In some embodiments, the endonuclease comprises at least 1, at least 2, at least 3, at least 4, or at least 5 peptide motifs selected from the group consisting of SEQ ID NOs: 5668-5678. In some embodiments, the endonuclease comprises a sequence at least 70%, 80%, or 90% identical to a sequence selected from the group consisting of SEQ ID NO: 930 or SEQ ID NOs: 930-1092. In some embodiments, the guide RNA structure comprises a sequence at least 70%, 80%, or 90% identical to SEQ ID NO: 5470 or SEQ ID NOs: 5506. In some embodiments, the endonuclease is configured to binding to a PAM comprising a sequence selected from the group consisting of SEQ ID NOs: 5521 or SEQ ID NOs: 5536. In some embodiments: (a) the endonuclease comprises a sequence at least 70%, 80%, or 90% identical to SEQ ID NO: 2751; (b) the guide RNA structure comprises a sequence at least 70%, 80%, or 90% identical to SEQ ID NO: 5470 or SEQ ID NO: 5506; and (c) the endonuclease is configured to binding to a PAM comprising SEQ ID NO: 5521 or SEQ ID NO: 5536.

In some embodiments, the endonuclease comprises a sequence at least 70%, 80%, or 90% identical to a sequence selected from the group consisting of SEQ ID NO: 2914 or SEQ ID NOs: 2914-3174. In some embodiments, the endonuclease comprises a sequence at least 70%, 80%, or 90% identical to a sequence selected from the group consisting of SEQ ID NO: 4728 or SEQ ID NOs: 4728-4988. In some embodiments, the endonuclease comprises at least 1, at least 2, or at least 3 peptide motifs selected from the group consisting of SEQ ID NOs: 5676-5678. In some embodiments, the endonuclease comprises a sequence at least 70%, 80%, or 90% identical to a sequence selected from the group consisting of SEQ ID NO: 1093 or SEQ ID NOs: 1093-1353. In some embodiments, the guide RNA structure comprises a sequence at least 70%, 80%, or 90% identical to a sequence selected from the group consisting of SEQ ID NO: 5471, SEQ ID NO: 5507, and SEQ ID NOs: 5540-5542. In some embodiments, the guide RNA structure comprises a tracr ribonucleic acid sequence predicted to comprise at least two hairpins comprising less than 5 base-paired ribonucleotides. In some embodiments, the endonuclease is configured to binding to a PAM comprising SEQ ID NO: 5522. In some embodiments: (a) the endonuclease comprises a sequence at least 70%, 80%, or 90% identical to SEQ ID NO: 2914; (b) the guide RNA structure comprises a sequence at least 70%, 80%, or 90% identical to SEQ ID NO: 5471 or SEQ ID NO: 5507; and (c) the endonuclease is configured to binding to a PAM comprising SEQ ID NO: 5522.

In some embodiments, the endonuclease comprises a sequence at least 70%, 80%, or 90% identical to a sequence selected from the group consisting of SEQ ID NO: 3175 or SEQ ID NOs: 3175-3330. In some embodiments, the endonuclease comprises a sequence at least 70%, 80%, or 90% identical to a sequence selected from the group consisting of SEQ ID NO: 4989 or SEQ ID NOs: 4989-5146. In some embodiments, the endonuclease comprises at least 1, at least 2, at least 3, at least 4, or at least 5 peptide motifs selected from the group consisting of SEQ ID NOs: 5679-5686. In some embodiments, the endonuclease comprises a sequence at least 70%, 80%, or 90% identical to a sequence selected from the group consisting of SEQ ID NO: 1354 or SEQ ID NOs: 1354-1511. In some embodiments, the guide RNA structure comprises a sequence at least 70%, 80%, or 90% identical to a sequence selected from the group consisting of SEQ ID NOs: 5472 or SEQ ID NOs: 5508. In some embodiments, the endonuclease is configured to binding to a PAM comprising a sequence selected from the group consisting of SEQ ID NO: 5523 or SEQ ID NO: 5537. In some embodiments: (a) the endonuclease comprises a sequence at least 70%, 80%, or 90% identical to SEQ ID NO: 3175; (b) the guide RNA structure comprises a sequence at least 70%, 80%, or 90% identical to SEQ ID NO: 5472 or SEQ ID NO: 5508; and (c) the endonuclease is configured to binding to a PAM comprising SEQ ID NO: 5523 or SEQ ID NO: 5537.

In some embodiments, the endonuclease comprises a sequence at least 70%, 80%, or 90% identical to a sequence selected from the group consisting of SEQ ID NOs: 3331 or SEQ ID NOs: 3331-3474. In some embodiments, the endonuclease comprises a sequence at least 70%, 80%, or 90% identical to a sequence selected from the group consisting of SEQ ID NOs: 5147 or SEQ ID NOs: 5147-5290. In some embodiments, the endonuclease comprises at least 1, at least 2, at least 3, at least 4, or at least 5 peptide motifs selected from the group consisting of SEQ ID NOs: 5674-5675 and SEQ ID NOs: 5687-5693. In some embodiments, the endonuclease comprises a sequence at least 70%, 80%, or 90% identical to a sequence selected from the group consisting of SEQ ID NO: 1512 or SEQ ID NOs: 1512-1655. In some embodiments, the guide RNA structure comprises a sequence at least 70%, 80%, or 90% identical to a sequence selected from the group consisting of SEQ ID NO: 5473 or SEQ ID NO: 5509. In some embodiments, the endonuclease is configured to binding to a PAM comprising SEQ ID NO: 5524. In some embodiments: (a) the endonuclease comprises a sequence at least 70%, 80%, or 90% identical to SEQ ID NO: 3331; (b) the guide RNA structure comprises a sequence at least 70%, 80%, or 90% identical to SEQ ID NO: 5473 or SEQ ID NO: 5509; and (c) the endonuclease is configured to binding to a PAM comprising SEQ ID NO: 5524.

In some embodiments, the endonuclease comprises a sequence at least 70%, 80%, or 90% identical to a sequence selected from the group consisting of SEQ ID NO: 3475 or SEQ ID NOs: 3475-3568. In some embodiments, the endonuclease comprises a sequence at least 70%, 80%, or 90% identical to a sequence selected from the group consisting of SEQ ID NO: 5291 or SEQ ID NOs: 5291-5389. In some embodiments, the endonuclease comprises at least 1, at least 2, at least 3, at least 4, or at least 5 peptide motifs selected from the group consisting of SEQ ID NOs: 5694-5699. In some embodiments, the endonuclease comprises a sequence at least 70%, 80%, or 90% identical to a sequence selected from the group consisting of SEQ ID NO: 1656 or SEQ ID NOs: 1656-1755. In some embodiments, the guide RNA structure comprises a sequence at least 70%, 80%, or 90% identical to SEQ ID NO: 5474 or SEQ ID NO: 5510. In some embodiments, the endonuclease is configured to binding to a PAM comprising SEQ ID NOs: 5525. In some embodiments: (a) the endonuclease comprises a sequence at least 70%, 80%, or 90% identical to SEQ ID NO: 3475; (b) the guide RNA structure comprises a sequence at least 70%, 80%, or 90% identical to SEQ ID NO: 5474 or SEQ ID NO: 5510; and (c) the endonuclease is configured to binding to a PAM comprising SEQ ID NO: 5525.

In some embodiments, the endonuclease comprises a sequence at least 70%, 80%, or 90% identical to a sequence selected from the group consisting of SEQ ID NO: 3569 or SEQ ID NOs: 3569-3637. In some embodiments, the endonuclease comprises a sequence at least 70%, 80%, or 90% identical to a sequence selected from the group consisting of SEQ ID NO: 5390 or SEQ ID NOs: 5390-5460. In some embodiments, the endonuclease comprises at least 1, at least 2, at least 3, at least 4, or at least 5 peptide motifs selected from the group consisting of SEQ ID NOs: 5700-5717. In some embodiments, the endonuclease comprises a sequence at least 70%, 80%, or 90% identical to a sequence selected from the group consisting of SEQ ID NO: 1756 or SEQ ID NOs: 1756-1826. In some embodiments, the guide RNA structure comprises a sequence at least 70%, 80%, or 90% identical to SEQ ID NO: 5475 or SEQ ID NOs: 5511. In some embodiments, the endonuclease is configured to binding to a PAM comprising SEQ ID NO: 5526. In some embodiments: (a) the endonuclease comprises a sequence at least 70%, 80%, or 90% identical to SEQ ID NO: 3569; (b) the guide RNA structure comprises a sequence at least 70%, 80%, or 90% identical to SEQ ID NO: 5475 or SEQ ID NO: 5511; and (c) the endonuclease is configured to binding to a PAM comprising SEQ ID NO: 5526. In some embodiments, the sequence identity is determined by a BLASTP, CLUSTALW, MUSCLE, MAFFT, or CLUSTALW with the parameters of the Smith-Waterman homology search algorithm. In some embodiments, the sequence identity is determined by the BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides for an engineered guide ribonucleic acid polynucleotide comprising: (a) a DNA-targeting segment comprising a nucleotide sequence that is complementary to a target sequence in a target DNA molecule; and (b) a protein-binding segment comprising two complementary stretches of nucleotides that hybridize to form a double-stranded RNA (dsRNA) duplex, wherein the two complementary stretches of nucleotides are covalently linked to one another with intervening nucleotides, and wherein the engineered guide ribonucleic acid polynucleotide is configured to forming a complex with an endonuclease comprising a RuvC_III domain having at least 70%, at least 75%, at least 80%, at least 85%, at least 88%, at least 90%, at least 92%, at least 95%, or at least 98% sequence identity to any one of SEQ ID NOs: 1827-3637 and targeting the complex to the target sequence of the target DNA molecule. In some embodiments, the DNA-targeting segment is positioned 5' of both of the two complementary stretches of nucleotides.

In some embodiments: (a) the protein binding segment comprises a sequence having at least 70%, at least 75%, at least 80%, at least 85%, at least 88%, at least 90%, at least 92%, at least 95%, or at least 98% identity to a sequence selected from the group consisting of SEQ ID NOs: 5476-5479 or SEQ ID NOs: 5476-5489; (b) the protein binding segment comprises a sequence having at least 70%, at least 80%, or at least 90% identity to a sequence selected from the group consisting of (SEQ ID NOs: 5490-5491 or SEQ ID NOs: 5490-5494) and SEQ ID NO: 5538; (c) the protein binding segment comprises a sequence having at least 70%, at least 80%, or at least 90% identity to a sequence selected from the group consisting of SEQ ID NOs: 5498-5499; (d) the protein binding segment comprises a sequence having at least 70%, at least 80%, or at least 90% identity to a sequence selected from the group consisting of SEQ ID NOs: 5495-5497 and SEQ ID NOs: 5500-5502; (e) the protein binding segment comprises a sequence having at least 70%, at least 80%, or at least 90% identity to SEQ ID NO: 5503; (f) the protein binding segment comprises a sequence having at least 70%, at least 80%, or at least 90% identity to SEQ ID NO: 5504; (g) the protein binding segment comprises a sequence having at least 70%, at least 80%, or at least 90% identity to SEQ ID NOs: 5505; (h) protein binding segment comprises a sequence having at least 70%, at least 80%, or at least 90% identity to SEQ ID NO: 5506; (i) protein binding segment comprises a sequence having at least 70%, at least 80%, or at least 90% identity to SEQ ID NO: 5507; (j) the protein binding segment comprises a sequence having at least 70%, at least 80%, or at least 90% identity to SEQ ID NO: 5508; (k) the protein binding segment comprises a sequence having at least 70%, at least 80%, or at least 90% identity to SEQ ID NO: 5509; (1) the protein binding segment comprises a sequence having at least 70%, at least 80%, or at least 90% identity to SEQ ID NO: 5510; or (m) the protein binding segment comprises a sequence having at least 70%, at least 80%, or at least 90% identity to SEQ ID NO: 5511.

In some embodiments: (a) the guide ribonucleic acid polynucleotide comprises an RNA sequence comprising a hairpin comprising a stem and a loop, wherein the stem comprises at least 10, at least 12, or at least 14 base-paired ribonucleotides, and an asymmetric bulge within 4 base pairs of the loop; (b) the guide ribonucleic acid polynucleotide comprises a tracr ribonucleic acid sequence predicted to comprise a hairpin comprising at least 8, at least 10, or at least 12 base-paired ribonucleotides; (c) the guide ribonucleic acid polynucleotide comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin; or (d) the guide ribonucleic acid polynucleotide comprises a tracr ribonucleic acid sequence predicted to comprise at least two hairpins comprising less than 5 base-paired ribonucleotides.

In some aspects, the present disclosure provides for a deoxyribonucleic acid polynucleotide encoding any of the engineered guide ribonucleic acid polynucleotides described herein.

In some aspects, the present disclosure provides for a nucleic acid comprising an engineered nucleic acid sequence optimized for expression in an organism, wherein the nucleic acid encodes a class 2, type II Cas endonuclease comprising a RuvC_III domain and an HNH domain, and wherein the endonuclease is derived from an uncultivated microorganism.

In some aspects, the present disclosure provides for a nucleic acid comprising an engineered nucleic acid sequence optimized for expression in an organism, wherein the nucleic acid encodes an endonuclease comprising a RuvC_III domain having at least 70% sequence identity to any one of SEQ ID NOs: 1827-3637. In some embodiments, the endonuclease comprises an HNH domain having at least 70% or at least 80% sequence identity to any one of SEQ ID NOs: 3638-5460. In some embodiments, the endonuclease comprises SEQ ID NOs: 5572-5591 or a variant thereof having at least 70% sequence identity thereto. In some embodiments, the endonuclease comprises a sequence encoding one or more nuclear localization sequences (NLSs) proximal to an N- or C-terminus of the endonuclease. In some embodiments, the NLS comprises a sequence selected from SEQ ID NOs: 5597-5612.

In some embodiments, the organism is prokaryotic, bacterial, eukaryotic, fungal, plant, mammalian, rodent, or human. In some embodiments, the organism is *E. coli*, and: (a) the nucleic acid sequence has at least 70%, 80%, or 90% identity to a sequence selected from the group consisting of SEQ ID NOs: 5572-5575; (b) the nucleic acid sequence has at least 70%, 80%, or 90% identity to a sequence selected from the group consisting of SEQ ID NOs: 5576-5577; (c) the nucleic acid sequence has at least 70%, 80%, or 90% identity to a sequence selected from the group consisting of SEQ ID NOs: 5578-5580; (d) the nucleic acid sequence has at least 70%, 80%, or 90% identity to SEQ ID NO: 5581; (e) the nucleic acid sequence has at least 70%, 80%, or 90% identity to SEQ ID NO: 5582; (f) the nucleic acid sequence has at least 70%, 80%, or 90% identity to SEQ ID NO: 5583; (g) the nucleic acid sequence has at least 70%, 80%, or 90% identity to SEQ ID NO: 5584; (h) the nucleic acid sequence has at least 70%, 80%, or 90% identity to SEQ ID NO: 5585; (i) the nucleic acid sequence has at least 70%, 80%, or 90% identity to SEQ ID NO: 5586; or (j) the nucleic acid sequence has at least 70%, 80%, or 90% identity to SEQ ID NO: 5587. In some embodiments, the organism is human, and: (a) the nucleic acid sequence has at least 70%, 80%, or 90% identity to SEQ ID NO: 5588 or SEQ ID NO: 5589; or (b) the nucleic acid sequence has at least 70%, 80%, or 90% identity to SEQ ID NO: 5590 or SEQ ID NO: 5591.

In some aspects, the present disclosure provides for a vector comprising a nucleic acid sequence encoding a class 2, type II Cas endonuclease comprising a RuvC_III domain and an HNH domain, wherein the endonuclease is derived from an uncultivated microorganism.

In some aspects, the present disclosure provides for a vector comprising the any of the nucleic acids described herein. In some embodiments, the vector further comprises a nucleic acid encoding an engineered guide ribonucleic acid structure configured to form a complex with the endonuclease comprising: (a) a guide ribonucleic acid sequence configured to hybridize to a target deoxyribonucleic acid sequence; and (b) a tracr ribonucleic acid sequence configured to binding to the endonuclease. In some embodiments, the vector is a plasmid, a minicircle, a CELiD, an adeno-associated virus (AAV) derived virion, or a lentivirus.

In some aspects, the present disclosure provides for a cell comprising any of the vectors described herein.

In some aspects, the present disclosure provides for a method of manufacturing an endonuclease, comprising cultivating any of the cells described herein.

In some aspects, the present disclosure provides for a method for binding, cleaving, marking, or modifying a double-stranded deoxyribonucleic acid polynucleotide, comprising: (a) contacting the double-stranded deoxyribonucleic acid polynucleotide with a class 2, type II Cas endonuclease in complex with an engineered guide ribonucleic acid structure configured to bind to the endonuclease and the double-stranded deoxyribonucleic acid polynucleotide; (b) wherein the double-stranded deoxyribonucleic acid polynucleotide comprises a protospacer adjacent motif (PAM); and (c) wherein the PAM comprises a sequence selected from the group consisting of SEQ ID NOs: 5512-5526 or SEQ ID NOs: 5527-5537. In some embodiments, the double-stranded deoxyribonucleic acid polynucleotide comprises a first strand comprising a sequence complementary to a sequence of the engineered guide ribonucleic acid structure and a second strand comprising the PAM. In some embodiments, the PAM is directly adjacent to the 3' end of the sequence complementary to the sequence of the engineered guide ribonucleic acid structure.

In some embodiments, the class 2, type II Cas endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II Cas endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some embodiments: (a) the PAM comprises a sequence selected from the group consisting of SEQ ID NOs: 5512-5515 and SEQ ID NOs: 5527-5530; (b) the PAM comprises SEQ ID NO: 5516 or SEQ ID NO: 5531; (c) the PAM comprises SEQ ID NO: 5539; (d) the PAM comprises SEQ ID NO: 5517 or SEQ ID NO: 5518; (e) the PAM comprises SEQ ID NO: 5519; (f) the PAM comprises SEQ ID NO: 5520 or SEQ ID NO: 5535; (g) the PAM comprises SEQ ID NO: 5521 or SEQ ID NO: 5536; (h) the PAM comprises SEQ ID NO: 5522; (i) the PAM comprises SEQ ID NO: 5523 or SEQ ID NO: 5537; (j) the PAM comprises SEQ ID NO: 5524; (k) the PAM comprises SEQ ID NO: 5525; or (l) the PAM comprises SEQ ID NO: 5526.

In some aspects, the present disclosure provides for a method of modifying a target nucleic acid locus, the method comprising delivering to the target nucleic acid locus any of the engineered nuclease systems described herein, wherein the endonuclease is configured to form a complex with the engineered guide ribonucleic acid structure, and wherein the complex is configured such that upon binding of the complex to the target nucleic acid locus, the complex modifies the target nucleic locus. In some embodiments, modifying the target nucleic acid locus comprises binding, nicking, cleaving, or marking the target nucleic acid locus. In some embodiments, the target nucleic acid locus comprises deoxyribonucleic acid (DNA) or ribonucleic acid (RNA). In some embodiments, the target nucleic acid comprises genomic DNA, viral DNA, viral RNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell.

In some embodiments, delivering the engineered nuclease system to the target nucleic acid locus comprises delivering any of the nucleic acids described herein or any of the vectors described herein. In some embodiments, delivering the engineered nuclease system to the target nucleic acid locus comprises delivering a nucleic acid comprising an open reading frame encoding the endonuclease. In some embodiments, the nucleic acid comprises a promoter to which the open reading frame encoding the endonuclease is operably linked. In some embodiments, the engineered nuclease system to the target nucleic acid locus comprises delivering a capped mRNA containing the open reading frame encoding the endonuclease. In some embodiments, the engineered nuclease system to the target nucleic acid locus comprises delivering a translated polypeptide. In some embodiments, the engineered nuclease system to the target nucleic acid locus comprises delivering a deoxyribonucleic acid (DNA) encoding the engineered guide ribonucleic acid structure operably linked to a ribonucleic acid (RNA) pol III promoter. In some embodiments, the endonuclease induces a single-stranded break or a double-stranded break at or proximal to the target locus.

In some aspects, the present disclosure provides for an engineered nuclease system comprising: (a) an endonuclease comprising a sequence having at least 75% sequence identity to any one of SEQ ID NOs: 5718-5846 or 6257; and (b) an engineered guide ribonucleic acid structure configured to form a complex with said endonuclease comprising: (i) a ribonucleic acid sequence configured to hybridize to a target deoxyribonucleic acid sequence; and (ii) a ribonucleic acid sequence configured to bind to said endonuclease. In some aspects, the present disclosure provides for an engineered nuclease system comprising: (a) an endonuclease configured to bind to a protospacer adjacent motif (PAM) sequence comprising SEQ ID NOs: 5847-5861 or 6258-6278, wherein said endonuclease is a class 2, type II Cas endonuclease; and (b) an engineered guide ribonucleic acid structure configured to form a complex with said endonuclease comprising: (i) a ribonucleic acid sequence configured to hybridize to a target deoxyribonucleic acid sequence; and (ii) a ribonucleic acid sequence configured to bind to said endonuclease. In some embodiments, said endonuclease is derived from an uncultivated microorganism. In some embodiments, said endonuclease has not been engineered to bind to a different PAM sequence. In some embodiments, said endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, said endonuclease has less than 80% identity to a Cas9 endonuclease. In some embodiments, said ribonucleic acid sequence comprises a sequence with at least 80% sequence identity to (a) any one of SEQ ID NOs: 5886-5887, 5891, 5893, or 5894; or (b) the non-degenerate nucleotides of any one of SEQ ID NOs: 5862-5885, 5888-5890, 5892, 5895-5896, or 6279-6301. In some aspects, the present disclosure provides for an engineered nuclease system comprising, (a) an engineered guide ribonucleic acid structure comprising: (i) a ribonucleic acid sequence configured to hybridize to a target deoxyribonucleic acid sequence; and (ii) a ribonucleic acid sequence configured to bind to an endonuclease, wherein said ribonucleic acid sequence comprises a sequence with at least 80% sequence identity (a) any one of SEQ ID NOs: 5886-5887, 5891, 5893, or 5894; or (b) the non-degenerate nucleotides of any one of SEQ ID NOs: 5862-5885, 5888-5890, 5892, 5895-5896, or 6279-6301; and a class 2, type II Cas endonuclease configured to bind to said engineered guide ribonucleic acid. In some embodiments, endonuclease is configured to bind to a protospacer adjacent motif (PAM) sequence selected from the group comprising SEQ ID NOs: 5847-5861 or 6258-6278. In some embodiments, said guide ribonucleic acid sequence is 15-24 nucleotides in length or 19-24 nucleotides in length. In some embodiments, said endonuclease comprises one or more nuclear localization sequences (NLSs) proximal to an N- or C-terminus of said endonuclease. In some embodiments, said NLS comprises a sequence selected from SEQ ID NOs: 5597-5612. In some embodiments, the system further comprises a single- or double-stranded DNA repair template comprising from 5' to 3': a first homology arm comprising a sequence of at least 20 nucleotides 5' to said target deoxyribonucleic acid sequence, a synthetic DNA sequence of at least 10 nucleotides, and a second homology arm comprising a sequence of at least 20 nucleotides 3' to said target sequence. In some embodiments, said first or second homology arm comprises a sequence of at least 40, 80, 120, 150, 200, 300, 500, or 1,000 nucleotides. In some embodiments, said sequence identity is determined by a BLASTP, CLUSTALW, MUSCLE, MAFFT, or CLUSTALW with the parameters of the Smith-Waterman homology search algorithm. In some embodiments, said sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides for an engineered guide ribonucleic acid polynucleotide comprising: (a) a DNA-targeting segment comprising a nucleotide sequence that is complementary to a target sequence in a target DNA molecule; and (b) a protein-binding segment comprising two complementary stretches of nucleotides that hybridize to form a double-stranded RNA (dsRNA) duplex, wherein said two complementary stretches of nucleotides are covalently linked to one another with intervening nucleotides, and wherein said engineered guide ribonucleic acid polynucleotide is configured to form a complex with an endonuclease comprising sequence having at least 75% sequence identity to any one of SEQ ID NOs: 5718-5846 or 6257 and target said complex to said target sequence of said target DNA molecule. In some embodiments, said DNA-targeting segment is positioned 5' of both of said two complementary stretches of nucleotides.

In some aspects, the present disclosure provides for a deoxyribonucleic acid polynucleotide encoding any of the engineered guide ribonucleic acid polynucleotides described herein.

In some aspects, the present disclosure provides for a nucleic acid comprising an engineered nucleic acid sequence optimized for expression in an organism, wherein said nucleic acid encodes an endonuclease comprising a sequence having at least 75% sequence identity to any one of SEQ ID NOs: 5718-5846 or 6257. In some embodiments, said endonuclease comprises a sequence encoding one or more nuclear localization sequences (NLSs) proximal to an N- or C-terminus of said endonuclease. In some embodiments, said NLS comprises a sequence selected from SEQ ID NOs: 5597-5612. In some embodiments, said organism is prokaryotic, bacterial, eukaryotic, fungal, plant, mammalian, rodent, or human.

In some aspects, the present disclosure provides for a vector comprising any of the nucleic acids described herein. In some embodiments, the vector further comprises a nucleic acid encoding an engineered guide ribonucleic acid structure configured to form a complex with said endonuclease comprising: (a) a ribonucleic acid sequence configured to hybridize to a target deoxyribonucleic acid sequence; and (b) a ribonucleic acid sequence configured to bind to said endonuclease. In some embodiments, the vector is a plasmid, a minicircle, a CELiD, an adeno-associated virus (AAV) derived virion, or a lentivirus.

In some aspects, the present disclosure provides for a cell comprising any of the vectors described herein In some aspects, the present disclosure provides for a method of manufacturing an endonuclease, comprising cultivating any of the cells described herein.

In some aspects, the present disclosure provides for a method for binding, cleaving, marking, or modifying a double-stranded deoxyribonucleic acid polynucleotide, comprising: contacting said double-stranded deoxyribonucleic acid polynucleotide with a class 2, type II Cas endonuclease in complex with an engineered guide ribonucleic acid structure configured to bind to said endonuclease and said double-stranded deoxyribonucleic acid polynucleotide; wherein said double-stranded deoxyribonucleic acid polynucleotide comprises a protospacer adjacent motif (PAM); and wherein said PAM comprises a sequence selected from the group consisting of SEQ ID NOs: 5847-5861 or 6258-6278. In some embodiments, said double-stranded deoxyribonucleic acid polynucleotide comprises a first strand comprising a sequence complementary to a sequence of said engineered guide ribonucleic acid structure and a second strand comprising said PAM. In some embodiments, said PAM is directly adjacent to the 3' end of said sequence complementary to said sequence of said engineered guide ribonucleic acid structure. In some embodiments, said class 2, type II Cas endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, said double-stranded deoxyribonucleic acid polynucleotide is a eukaryotic, plant, fungal, mammalian, rodent, or human double-stranded deoxyribonucleic acid polynucleotide.

In some aspects, the present disclosure provides for a method of modifying a target nucleic acid locus, said method comprising delivering to said target nucleic acid locus any of the engineered nuclease systems described herein, wherein said endonuclease is configured to form a complex with said engineered guide ribonucleic acid structure, and wherein said complex is configured such that upon binding of said complex to said target nucleic acid locus, said complex modifies said target nucleic locus. In some embodiments, said target nucleic acid locus comprises binding, nicking, cleaving, or marking said target nucleic acid locus. In some embodiments, said target nucleic acid locus comprises deoxyribonucleic acid (DNA) or ribonucleic acid (RNA). In some embodiments, said target nucleic acid comprises genomic DNA, viral DNA, viral RNA, or bacterial DNA. In some embodiments, said target nucleic acid locus is in vitro. In some embodiments, said target nucleic acid locus is within a cell. In some embodiments, said cell is a prokaryotic cell, a bacterial cell, a eukaryotic cell, a fungal cell, a plant cell, an animal cell, a mammalian cell, a rodent cell, a primate cell, or a human cell. In some embodiments, said engineered nuclease system to said target nucleic acid locus comprises delivering any of the nucleic acids described herein or any of the vectors described herein. In some embodiments, delivering said engineered nuclease system to said target nucleic acid locus comprises delivering a nucleic acid comprising an open reading frame encoding said endonuclease. In some embodiments, said nucleic acid comprises a promoter to which said open reading frame encoding said endonuclease is operably linked. In some embodiments, delivering said engineered nuclease system to said target nucleic acid locus comprises delivering a capped mRNA containing said open reading frame encoding said endonuclease. In some embodiments, delivering said engineered nuclease system to said target nucleic acid locus comprises delivering a translated polypeptide. In some embodiments, delivering said engineered nuclease system to said target nucleic acid locus comprises delivering a deoxyribonucleic acid (DNA) encoding said engineered guide ribonucleic acid structure operably linked to a ribonucleic acid (RNA) pol III promoter. In some embodiments, said endonuclease induces a single-stranded break or a double-stranded break at or proximal to said target locus.

In some aspects, the present disclosure provides for a method of editing a TRAC locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said TRAC locus, wherein said engineered guide RNA comprises a targeting sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides of any one of SEQ ID NOs: 5950-5958 or 5959-5965. In some embodiments, said RNA-guided endonuclease is a class II, type II Cas endonuclease. In some embodiments, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some embodiments, said RNA-guided endonuclease further comprises an HNH domain. In some embodiments, said RNA-guided endonuclease comprises a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 421 or SEQ ID NO: 423. In some embodiments, said engineered guide RNA comprises a targeting sequence having at least 85% identity to at least 18 consecutive nucleotides of any one of SEQ ID NOs: 5950-5958 and said endonuclease comprises a sequence having at least 75% identity to SEQ ID NO:421. In some embodiments, said engineered guide RNA comprises a targeting sequence having at least 85% identity to at least 18 consecutive nucleotides of any one of SEQ ID NOs: 5959-5965 and said endonuclease comprises a sequence having at least 75% identity to SEQ ID NO: 423. In some embodiments, said engineered guide RNA comprises a targeting sequence having at least 85% identity to at least 18 consecutive nucleotides of any one of SEQ ID NOs: 5953-5957. In some embodiments, said engineered guide RNA comprises a targeting sequence having at least 85% identity to at least 18 consecutive nucleotides of any one of SEQ ID NOs: 5960-5961 or 5963-5964.

In some aspects, the present disclosure provides for a method of editing a TRBC locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said TRBC locus, wherein said engineered guide RNA comprises a targeting sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides of any one of SEQ ID NOs: 5966-6004 or 6005-6025. In some embodiments, said RNA-guided endonuclease is a class II, type II Cas endonuclease. In some embodiments, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some embodiments, said RNA-guided endonuclease further comprises an HNH domain. In some embodiments, said RNA-guided endonuclease comprises a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 421 or SEQ ID NO: 423. In some embodiments, said engineered guide RNA comprises a targeting sequence having at least 85% identity to at least 18 consecutive nucleotides of any one of SEQ ID NOs: 5966-6004 and said endonuclease comprises a sequence having at least 75% identity to SEQ ID NO: 421. In some embodiments, said engineered guide RNA comprises a targeting sequence having at least 85% identity to at least 18 consecutive nucleotides of any one of SEQ ID NOs: 6005-6025 and said endonuclease comprises a sequence having at least 75% identity to SEQ ID NO: 423. In some embodiments, said engineered guide RNA comprises a targeting sequence having at least 85% identity to at least 18 consecutive nucleotides of any one of SEQ ID NOs: 5970, 5971, 5983, or 5984. In some embodiments, said engineered guide RNA comprises a targeting sequence having at least 85% identity to at least 18 consecutive nucleotides of any one of SEQ ID NOs: 6006, 6010, 6011, or 6012.

In some aspects, the present disclosure provides for a method of editing a GR (NR3C1) locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said GR (NR3C1) locus, wherein said engineered guide RNA comprises a targeting sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides consecutive nucleotides of any one of SEQ ID NOs: 6026-6090 or 6091-6121. In some embodiments, said RNA-guided endonuclease is a class II, type II Cas endonuclease. In some embodiments, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some embodiments, said RNA-guided endonuclease further comprises an HNH domain. In some embodiments, said RNA-guided endonuclease comprises a sequence having at least 75% identity to SEQ ID NO: 421 or SEQ ID NO: 423. In some embodiments, said engineered guide RNA comprises a targeting sequence having at least 85% identity to at least 18 consecutive nucleotides of any one of SEQ ID NOs: 6026-6090 and said endonuclease comprises a sequence having at least 75% identity to SEQ ID NO: 421. In some embodiments, said engineered guide RNA comprises a targeting sequence having at least 85% identity to at least 18 consecutive nucleotides of any one of SEQ ID NOs: 6091-6121 and said endonuclease comprises a sequence having at least 75% identity to SEQ ID NO: 423. In some embodiments, said engineered guide RNA comprises a targeting sequence having at least 85% identity to at least 18 consecutive nucleotides of any one of SEQ ID NOs: 6027-6028, 6029, 6038, 6043, 6049, 6076, 6080, 6081, or 6086. In some embodiments, said engineered guide RNA comprises a targeting sequence having at least 85% identity to at least 18 consecutive nucleotides of any one of SEQ ID NOs: 6092, 6115, or 6119.

In some aspects, the present disclosure provides for a method of editing an AAVS1 locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said AAVS1 locus, wherein said engineered guide RNA comprises a targeting sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides of any one of SEQ ID NOs: 6122-6152. In some embodiments, said RNA-guided endonuclease is a class II, type II Cas endonuclease. In some embodiments, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some embodiments, said RNA-guided endonuclease further comprises an HNH domain. In some embodiments, said RNA-guided endonuclease comprises a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 421 or SEQ ID NO: 423. In some embodiments, said engineered guide RNA comprises a targeting sequence having at least 85% identity to at least 18 consecutive nucleotides of any one of SEQ ID NOs: 6122, 6125-6126, 6128, 6131, 6133, 6136, 6141, 6143, or 6148.

In some aspects, the present disclosure provides for a method of editing an TIGIT locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said TIGIT locus, wherein said engineered guide RNA comprises a targeting sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides of any one of SEQ ID NOs: 6153-6181. In some embodiments, said RNA-guided endonuclease is a class II, type II Cas endonuclease. In some embodiments, said RNA-guided endonuclease comprises a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 421 or SEQ ID NO: 423. In some embodiments, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some embodiments, said RNA-guided endonuclease further comprises an HNH domain. In some embodiments, said engineered guide RNA comprises a targeting sequence having at least 85% identity to at least 18 consecutive nucleotides of any one of SEQ ID NOs: 66155, 6159, 616, or 6172.

In some aspects, the present disclosure provides for a method of editing an CD38 locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said CD38 locus, wherein said engineered guide RNA comprises a targeting sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides of any one of SEQ ID NOs: 6182-6248 or 6249-6256. In some embodiments, said RNA-guided endonuclease is a class II, type II Cas endonuclease. In some embodiments, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some embodiments, said RNA-guided endonuclease further comprises an HNH domain. In some embodiments, said RNA-guided endonuclease comprises a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 421 or SEQ ID NO: 423. In some embodiments, said engineered guide RNA comprises a targeting sequence having at least 85% identity to at least 18 consecutive nucleotides of any one of SEQ ID NOs: 6182-6248 and said endonuclease comprises a sequence having at least 75% identity to SEQ ID NO: 421. In some embodiments, said engineered guide RNA comprises a targeting sequence having at least 85% identity to at least 18 consecutive nucleotides of any one of SEQ ID NOs: 6249-

6256 and said endonuclease comprises a sequence having at least 75% identity to SEQ ID NO: 423. In some embodiments, said engineered guide RNA comprises a targeting sequence having at least 85% identity to at least 18 consecutive nucleotides of any one of SEQ ID NOs: 6182-6183, 6189, 6191, 6208, 6210, 6211, or 6215. In some embodiments, said engineered guide RNA comprises a targeting sequence having at least 85% identity to at least 18 consecutive nucleotides of SEQ ID NO: 6251.

In some embodiments of any of the methods for editing particular loci in cells above, said cell is a peripheral blood mononuclear cell, a T-cell, an NK cell, a hematopoietic stem cell (HSCT), or a B-cell, or any combination thereof.

In some aspects, the present disclosure provides for an engineered guide ribonucleic acid polynucleotide comprising: (a) a DNA-targeting segment comprising a nucleotide sequence that is complementary to a target sequence in a target DNA molecule; and (b) a protein-binding segment comprising two complementary stretches of nucleotides that hybridize to form a double-stranded RNA (dsRNA) duplex, wherein said two complementary stretches of nucleotides are covalently linked to one another with intervening nucleotides, and wherein said engineered guide ribonucleic acid polynucleotide is configured to form a complex with a class 2, type II Cas endonuclease and target said complex to said target sequence of said target DNA molecule, wherein said DNA-targeting segment comprises a sequence having at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to at least 19, at least 20, at least 21, at least 22, at least 23, or at least 24 consecutive nucleotides of any one of SEQ ID NOs: 5950-5965, 5966-6025, 6026-6121, 6122-6152, 6153-6181, or 6182-6256. In some embodiments, said protein-binding segment comprises a sequence having at least 85% identity to any one of SEQ ID NOs: 5466 or 6304.

In some aspects, the present disclosure provides for a system for generating an edited immune cell, comprising: (a) an RNA-guided endonuclease; (b) an engineered guide ribonucleic acid polynucleotide configured to bind said RNA-guided endonuclease; and (c) a single- or double-stranded DNA repair template comprising first and second homology arms flanking a sequence encoding a chimeric antigen receptor (CAR). In some embodiments, said cell is a peripheral blood mononuclear cell, a T-cell, an NK cell, a hematopoietic stem cell (HSCT), or a B-cell, or any combination thereof. In some aspects, said RNA-guided endonuclease is a class II, type II Cas endonuclease. In some aspects, said RNA-guided endonuclease comprises a RuvCIII domain comprising a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 2242 or SEQ ID NO: 2244. In some aspects, said RNA-guided endonuclease further comprises an HNH domain. In some aspects, said RNA-guided endonuclease comprises a sequence having at least 75% identity, at least 80% identity, at least 82% identity, at least 84% identity, at least 86% identity, at least 88% identity, at least 90% identity, at least 91% identity, at least 92% identity, at least 93% identity, at least 94% identity, at least 95% identity, at least 96% identity, at least 97% identity, at least 98% identity, at least 99% identity, or at least 100% identity to SEQ ID NO: 421 or SEQ ID NO: 423.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

In some aspects, the present disclosure provides for a method of editing a B2M locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said B2M locus, wherein said region of said B2M locus comprises a targeting sequence having at least 85% identity to at least 18 consecutive nucleotides of any one of SEQ ID NOs: 6387-6468. In some embodiments, said RNA-guided endonuclease is a Cas endonuclease. In some embodiments, said Cas endonuclease is a class 2, type II Cas endonuclease. In some embodiments, said class 2, type II Cas endonuclease comprises an endonuclease having at least 75% sequence identity to any one of SEQ ID NOs: 421-431. In some embodiments, said RNA-guided endonuclease comprises a RuvCIII domain comprising a sequence having at least 75% sequence identity to SEQ ID NO: 2242 or SEQ ID NO: 2244. In some embodiments, said RNA-guided endonuclease further comprises an HNH domain. In some embodiments, said RNA-guided endonuclease comprises a sequence at least 75%, 80%, or 90% identical to SEQ ID NO: 421. In some embodiments, said engineered guide RNA comprises a sequence having at least 80% identity to any one of SEQ ID NOs: 6305-6386. In some embodiments, said region of said B2M locus comprises a sequence at least 75%, 80%, or 90% identical to at least 19 of the non-degenerate nucleotides of any one of SEQ ID NOs: 6388, 6399, 6401, 6403, 6410, 6413, 6421, 6446, and 6448. In some embodiments, said engineered guide RNA comprises a sequence at 80%, or at least 90% identical to any one of SEQ ID NOs: 6306, 6317, 6319, 6321, 6328, 6331, 6339, 6364, and 6366.

In some aspects, the present disclosure provides for a method of editing a TRAC locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said TRAC locus, wherein said region of said TRAC locus comprises a targeting sequence having at least 85% identity to at least 18 consecutive nucleotides of any one of SEQ ID NOs: 6509-6548. In some embodiments, said RNA-guided endonuclease is a Cas endonuclease. In some embodiments, said Cas endonuclease is a class 2, type II Cas endonuclease. In some embodiments, said class 2, type II Cas endonuclease comprises an endonuclease having at least 75% sequence identity to any one of SEQ ID NOs: 421-431. In some embodiments, said RNA-guided endonuclease comprises a RuvCIII domain comprising a sequence having at least 75% sequence identity to SEQ ID NO: 2242 or SEQ ID NO: 2244. In some embodiments, said RNA-guided endonuclease further comprises an HNH domain. In some embodiments, said RNA-guided endonuclease comprises a sequence at least 75%, 80%, or 90% identical to SEQ ID NO: 421. In some embodiments, said engineered guide RNA comprises a sequence having at least 80% identity to any one of SEQ ID NOs: 6469-6508. In some embodiments, said region of said TRAC locus comprises a sequence at least 75%, 80%, or 90% identical to at least 19 of the non-degenerate nucleotides of any one of SEQ ID NOs: 6517, 6520, and 6523. In some embodiments, said engineered guide RNA comprises a sequence at 80%, or at least 90% identical to any one of SEQ ID NOs: 6477, 6480, and 6483.

In some aspects, the present disclosure provides for a method of editing a HPRT locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said HPRT locus, wherein said region of said HPRT locus comprises a targeting sequence having at least 85% identity to at least 18 consecutive nucleotides of any one of SEQ ID NOs: 6616-6682. In some embodiments, said RNA-guided endonuclease is a Cas endonuclease. In some embodiments, said Cas endonuclease is a class 2, type II Cas endonuclease. In some embodiments, said class 2, type II Cas endonuclease comprises an endonuclease having at least 75% sequence identity to any one of SEQ ID NOs: 421-431. In some embodiments, said RNA-guided endonuclease comprises a RuvCIII domain comprising a sequence having at least 75% sequence identity to SEQ ID NO: 2242 or SEQ ID NO: 2244. In some embodiments, said RNA-guided endonuclease further comprises an HNH domain. In some embodiments, said RNA-guided endonuclease comprises a sequence at least 75%, 80%, or 90% identical to SEQ ID NO: 421 or SEQ ID NO: 423. In some embodiments, said engineered guide RNA comprises a sequence having at least 80% identity to any one of SEQ ID NOs: 6549-6615. In some embodiments, said region of said HPRT locus comprises a sequence at least 75%, 80%, or 90% identical to at least 19 of the non-degenerate nucleotides of any one of SEQ ID NOs: 6619, 6634, 6673, 6675, and 6679. In some embodiments, said engineered guide RNA comprises a sequence at 80%, or at least 90% identical to any one of SEQ ID NOs: 6552, 6567, 6606, 6608, and 6612.

In some aspects, the present disclosure provides for a method of editing a TRBC1/2 locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said TRBC1/2 locus, wherein said region of said TRBC1/2 locus comprises a targeting sequence having at least 85% identity to at least 18 consecutive nucleotides of any one of SEQ ID NOs: 6722-6760 or 6782-6802. In some embodiments, said RNA-guided endonuclease is a Cas endonuclease. In some embodiments, said Cas endonuclease is a class 2, type II Cas endonuclease. In some embodiments, said class 2, type II Cas endonuclease comprises an endonuclease having at least 75% sequence identity to any one of SEQ ID NOs: 421-431. In some embodiments, said RNA-guided endonuclease comprises a RuvCIII domain comprising a sequence having at least 75% sequence identity to SEQ ID NO: 2242 or SEQ ID NO: 2244. In some embodiments, said RNA-guided endonuclease further comprises an HNH domain. In some embodiments, said RNA-guided endonuclease comprises a sequence at least 75%, 80%, or 90% identical to SEQ ID NO: 421 or SEQ ID NO: 423. In some embodiments, said engineered guide RNA comprises a sequence having at least 80% identity to any one of SEQ ID NOs: 6683-6721 and 6761-6781. In some embodiments, said region of said TRBC1/2 locus comprises a sequence at least 75%, 80%, or 90% identical to at least 19 of the non-degenerate nucleotides of any one of SEQ ID NOs: 6734, 6753, 6790, and 6800. In some embodiments, said engineered guide RNA comprises a sequence at 80%, or at least 90% identical to any one of SEQ ID NOs: 6695, 6714, 6769, and 6779.

In some aspects, the present disclosure provides for a method of editing a HAO1 locus in a cell, comprising contacting to said cell (a) an RNA-guided endonuclease; and (b) an engineered guide RNA, wherein said engineered guide RNA is configured to form a complex with said endonuclease and said engineered guide RNA comprises a spacer sequence configured to hybridize to a region of said HAO1 locus, wherein said region of said HAO1 locus comprises a targeting sequence having at least 85% identity to at least 18 consecutive nucleotides of any one of SEQ ID NOs: 11802-11820. In some embodiments, said RNA-guided endonuclease is a Cas endonuclease. In some embodiments, said Cas endonuclease is a class 2, type II Cas endonuclease. In some embodiments, said class 2, type II Cas endonuclease comprises an endonuclease having at least 75% sequence identity to any one of SEQ ID NOs: 421-431. In some embodiments, said RNA-guided endonuclease comprises a RuvCIII domain comprising a sequence having at least 75% sequence identity to SEQ ID NO: 2242. In some embodiments, said RNA-guided endonuclease further comprises an HNH domain. In some embodiments, said RNA-guided endonuclease comprises a sequence at least 75%, 80%, or 90% identical to SEQ ID NO: 421. In some embodiments, said region of said HAO1 locus comprises a sequence at least 75%, 80%, or 90% identical to at least 19 of the non-degenerate nucleotides of any one of SEQ ID NOs: 11806, 11813, 11816, and 11819. In some embodiments, said cell is a peripheral blood mononuclear cell (PBMC). In some embodiments, said cell is a T-cell or a precursor thereof or a hematopoietic stem cell (HSC).

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

BRIEF DESCRIPTION OF THE SEQUENCE LISTING

Figure 1:
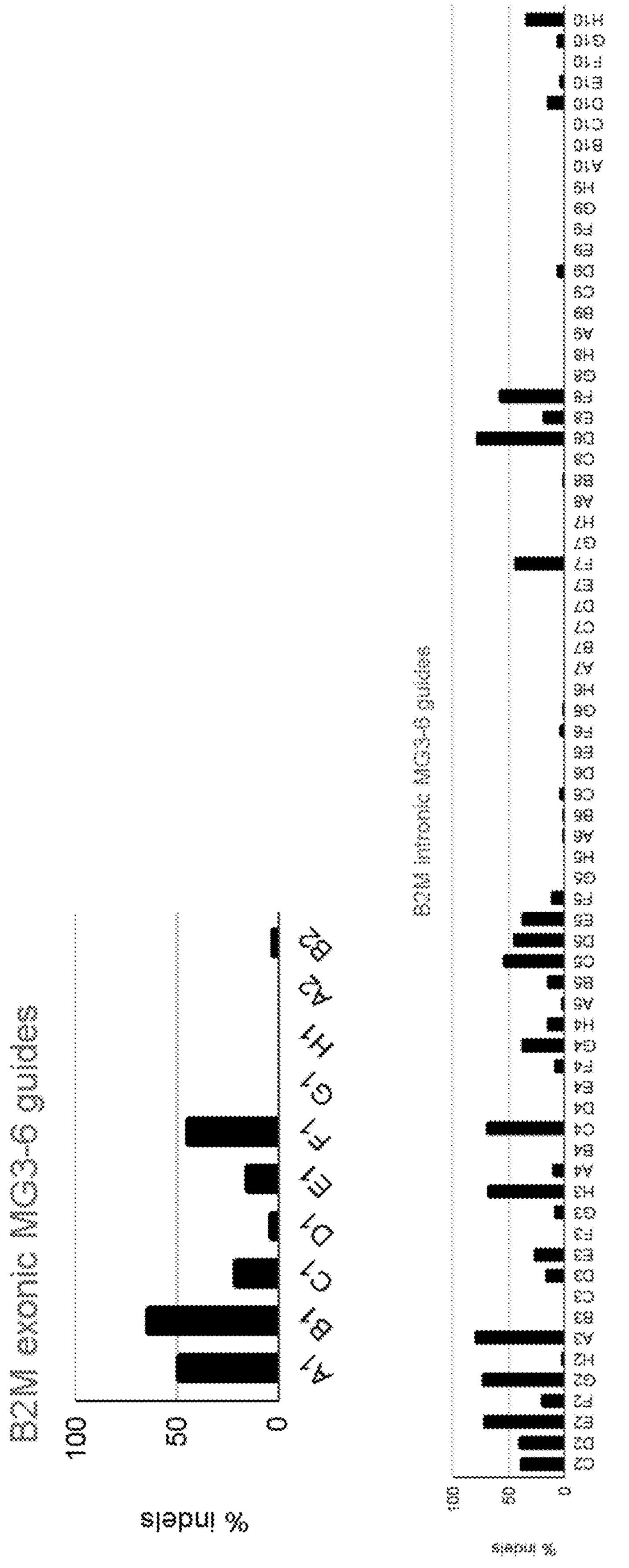
FIG. 1 depicts the gene editing outcomes at the DNA level for B2M.

The Sequence Listing filed herewith provides exemplary polynucleotide and polypeptide sequences for use in methods, compositions and systems according to the disclosure. Below are exemplary descriptions of sequences therein.

MG1

SEQ ID NOs: 1-319 and 7285-7293 show the full-length peptide sequences of MG1 nucleases.

SEQ ID NOs: 1827-2140 show the peptide sequences of RuvC_III domains of MG1 nucleases above.

SEQ ID NOs: 3638-3955 show the peptide of HNH domains of MG1 nucleases above.

SEQ ID NOs: 5476-5479 show the nucleotide sequences of MG1 tracrRNAs derived from the same loci as MG1 nucleases above (e.g., same loci as SEQ ID NO:1-4, respectively).

SEQ ID NOs: 5461-5464 and 11130 show the nucleotide sequences of sgRNAs engineered to function with an MG1 nuclease (e.g., SEQ ID NO:1-4, respectively), where Ns denote nucleotides of a targeting sequence.

SEQ ID NOs: 5572-5575 show nucleotide sequences for *E. coli* codon-optimized coding sequences for MG1 family enzymes (SEQ ID NOs: 1-4).

SEQ ID NOs: 5588-5589 show nucleotide sequences for human codon-optimized coding sequences for MG1 family enzymes (SEQ ID NOs: 1 and 3).

SEQ ID NOs: 5616-5632 show peptide motifs characteristic of MG1 family enzymes.

SEQ ID NOs: 9192-9255 show the peptide sequences of PAM-interacting domains of MG1 nucleases.

SEQ ID NOs: 11229-11269 show the nucleotide sequences of target sites of MG1 nucleases.

MG2

SEQ ID NOs: 320-420 and 7294-7358 show the full-length peptide sequences of MG2 nucleases.

SEQ ID NOs: 2141-2241 show the peptide sequences of RuvC_III domains of MG2 nucleases above.

SEQ ID NOs: 3955-4055 show the peptide of HNH domains of MG2 nucleases above.

SEQ ID NOs: 5490-5494 and 11159 show the nucleotide sequences of MG2 tracrRNAs derived from the same loci as MG2 nucleases above (e.g., same loci as SEQ ID NOs: 320, 321, 323, 325, and 326, respectively).

SEQ ID NO: 5465 shows the nucleotide sequence of an sgRNA engineered to function with an MG2 nuclease (e.g., SEQ ID NO: 321 above).

SEQ ID NOs: 5572-5575 show nucleotide sequences for *E. coli* codon-optimized coding sequences for MG2 family enzymes.

SEQ ID NOs: 5631-5638 show peptide sequences characteristic of MG2 family enzymes.

SEQ ID NOs: 9256-9322 show the peptide sequences of PAM-interacting domains of MG2 nucleases.

SEQ ID NOs: 11270-11275 show the nucleotide sequences of target sites of MG2 nucleases.

MG3

SEQ ID NOs: 421-431 show the full-length peptide sequences of MG3 nucleases.

SEQ ID NO: 6803 shows the nucleotide sequence of an MG3-6 nuclease containing 5' UTR, NLS, CDS, NLS, 3' UTR, and polyA tail.

SEQ ID NOs: 2242-2252 show the peptide sequences of RuvC_III domains of MG3 nucleases above.

SEQ ID NOs: 4056-4066 show the peptide of HNH domains of MG3 nucleases above.

SEQ ID NOs: 5495-5502 and 11160-11162 show the nucleotide sequences of MG3 tracrRNAs derived from the same loci as MG3 nucleases above (e.g., same loci as SEQ ID NOs: 421-428, respectively).

SEQ ID NOs: 5466-5467, 11131, and 11567-11576 show the nucleotide sequences of sgRNAs engineered to function with MG3 nucleases (e.g., SEQ ID NOs: 421-423).

SEQ ID NOs: 5578-5580 show nucleotide sequences for *E. coli* codon-optimized coding sequences for MG3 family enzymes.

SEQ ID NOs: 5639-5648 show peptide sequences characteristic of MG3 family enzymes.

SEQ ID NOs: 9323-9329 show the peptide sequences of PAM-interacting domains of MG3 nucleases.

SEQ ID NOs: 11108 and 11530-11538 show the nucleotide sequences of single guide PAMs of MG3 nucleases.

SEQ ID NOs: 11276-11294 show the nucleotide sequences of target sites of MG1 nucleases.

SEQ ID NO: 11373 shows the nucleotide sequence of a DNA sequence encoding MG3-6 mRNA.

MG3a

SEQ ID NOs: 7369-7375 show the full-length peptide sequences of MG3a nucleases.

SEQ ID NOs: 11099 show the peptide sequences of PAM-interacting domains of MG3a nucleases.

MG3b

SEQ ID NOs: 7376-7390 show the full-length peptide sequences of MG3b nucleases.

SEQ ID NOs: 11100-11107 show the peptide sequences of PAM-interacting domains of MG3b nucleases.

MG4

SEQ ID NOs: 432-660 and 7391-7535 show the full-length peptide sequences of MG4 nucleases.

SEQ ID NOs: 2253-2481 show the peptide sequences of RuvC_III domains of MG4 nucleases above.

SEQ ID NOs: 4067-4295 show the peptide of HNH domains of MG4 nucleases above.

SEQ ID NO: 5503 shows the nucleotide sequences of an MG4 tracrRNA derived from the same loci as MG4 nucleases above.

SEQ ID NO: 5468 shows the nucleotide sequence of sgRNAs engineered to function with an MG4 nuclease.

SEQ ID NO: 5649 shows a peptide sequence characteristic of MG4 family enzymes.

SEQ ID NOs: 9330-9485 show the peptide sequences of PAM-interacting domains of MG4 nucleases.

SEQ ID NOs: 11295-11303 show the nucleotide sequences of target sites of MG4 nucleases.

MG5

SEQ ID NOs: 7536-7583 show the full-length peptide sequences of MG5 nucleases.

SEQ ID NOs: 9486-9526 show the peptide sequences of PAM-interacting domains of MG5 nucleases.

MG6

SEQ ID NOs: 661-668 and 7584-7587 show the full-length peptide sequences of MG6 nucleases.

SEQ ID NOs: 2482-2489 show the peptide sequences of RuvC_III domains of MG6 nucleases above.

SEQ ID NOs: 4296-4303 show the peptide of HNH domains of MG3 nucleases above.

SEQ ID NOs: 9527-9531 show the peptide sequences of PAM-interacting domains of MG6 nucleases.

MG7

SEQ ID NOs: 669-677 show the full-length peptide sequences of MG7 nucleases.

SEQ ID NOs: 2490-2498 show the peptide sequences of RuvC_III domains of MG7 nucleases above.

SEQ ID NOs: 4304-4312 show the peptide of HNH domains of MG3 nucleases above.

SEQ ID NO: 5504 shows the nucleotide sequence of an MG7 tracrRNA derived from the same loci as MG7 nucleases above.

SEQ ID NOs: 9532-9535 show the peptide sequences of PAM-interacting domains of MG7 nucleases.

MG14

SEQ ID NOs: 678-929 and 7588-7597 show the full-length peptide sequences of MG14 nucleases.

SEQ ID NOs: 2499-2750 show the peptide sequences of RuvC_III domains of MG14 nucleases above.

SEQ ID NOs: 4313-4564 show the peptide of HNH domains of MG14 nucleases above.

SEQ ID NOs: 5505 and 11163-11167 show nucleotide sequences of MG14 tracrRNAs derived from the same loci as MG14 nucleases above.

SEQ ID NO: 5581 shows a nucleotide sequence for an *E. coli* codon-optimized coding sequences for an MG14 family enzyme.

SEQ ID NOs: 5650-5667 show peptide sequences characteristic of MG14 family enzymes.

SEQ ID NOs: 9536-9611 show the peptide sequences of PAM-interacting domains of MG14 nucleases.

SEQ ID NOs: 11109-11113 show the nucleotide sequences of single guide PAMs of MG14 nucleases.

SEQ ID NOs: 11132-11136 shows the nucleotide sequence of sgRNAs engineered to function with an MG14 nuclease.

SEQ ID NOs: 11304-11312 show the nucleotide sequences of target sites of MG14 nucleases.

MG15

SEQ ID NOs: 930-1092, 7598-7622, and 11593-11616 show the full-length peptide sequences of MG15 nucleases.

SEQ ID NOs: 2751-2913 show the peptide sequences of RuvC_III domains of MG15 nucleases above.

SEQ ID NOs: 4565-4727 show the peptide of HNH domains of MG15 nucleases above.

SEQ ID NOs: 5506 and 11168-11172 show nucleotide sequences of MG15 tracrRNAs derived from the same loci as MG15 nucleases above.

SEQ ID NOs: 5470 and 11577-11592 show the nucleotide sequences of sgRNAs engineered to function with MG15 nucleases.

SEQ ID NO: 5582 shows a nucleotide sequence for an *E. coli* codon-optimized coding sequences for an MG15 family enzyme.

SEQ ID NOs: 5668-5675 show peptide sequences characteristic of MG15 family enzymes.

SEQ ID NOs: 9612-9671 show the peptide sequences of PAM-interacting domains of MG15 nucleases.

SEQ ID NOs: 11539-11554 show the nucleotide sequences of single guide PAMs of MG15 nucleases.

MG16

SEQ ID NOs: 1093-1353 and 7623-7698 show the full-length peptide sequences of MG16 nucleases.

SEQ ID NOs: 2914-3174 show the peptide sequences of RuvC_III domains of MG16 nucleases above.

SEQ ID NOs: 4728-4988 show the peptide of HNH domains of MG16 nucleases above.

SEQ ID NOs: 5507 and 11173-11174 show nucleotide sequences of MG16 tracrRNAs derived from the same loci as MG16 nucleases above.

SEQ ID NOs: 5471 and 11137 show nucleotide sequences of sgRNAs engineered to function with an MG16 nuclease.

SEQ ID NO: 5583 shows a nucleotide sequence for an *E. coli* codon-optimized coding sequences for an MG16 family enzyme.

SEQ ID NOs: 5676-5678 show peptide sequences characteristic of MG16 family enzymes.

SEQ ID NOs: 9672-9842 show the peptide sequences of PAM-interacting domains of MG16 nucleases.

SEQ ID NO: 11114 shows the nucleotide sequence of a single guide PAM of an MG16 nuclease.

SEQ ID NOs: 11313-11320 show the nucleotide sequences of target sites of MG16 nucleases.

MG17

SEQ ID NOs: 7699-7715 show the full-length peptide sequences of MG17 nucleases.

SEQ ID NOs: 9843-9856 show the peptide sequences of PAM-interacting domains of MG17 nucleases.

SEQ ID NO: 11115 shows the nucleotide sequence of a single guide PAM of an MG17 nuclease.

SEQ ID NO: 11138 shows the nucleotide sequence of an sgRNA engineered to function with an MG17 nuclease.

SEQ ID NO: 11175 shows the nucleotide sequence of an MG17 tracrRNA derived from the same loci as MG17 nucleases above.

MG18

SEQ ID NOs: 1354-1511 show the full-length peptide sequences of MG18 nucleases.

SEQ ID NOs: 3175-3330 show the peptide sequences of RuvC_III domains of MG18 nucleases above.

SEQ ID NOs: 4989-5146 show the peptide of HNH domains of MG18 nucleases above.

SEQ ID NO: 5508 shows the nucleotide sequences of MG18 tracrRNA derived from the same loci as MG18 nucleases above.

SEQ ID NOs: 5472 shows the nucleotide sequence of an sgRNA engineered to function with an MG18 nuclease.

SEQ ID NO: 5584 shows a nucleotide sequence for an *E. coli* codon-optimized coding sequences for an MG18 family enzyme.

SEQ ID NOs: 5679-5686 show peptide sequences characteristic of MG18 family enzymes.

SEQ ID NOs: 9857-9891 show the peptide sequences of PAM-interacting domains of MG18 nucleases.

SEQ ID NOs: 11321-11327 show the nucleotide sequences of target sites of MG18 nucleases.

MG21

SEQ ID NOs: 1512-1655 and 7716-7733 show the full-length peptide sequences of MG21 nucleases.

SEQ ID NOs: 3331-3474 show the peptide sequences of RuvC_III domains of MG21 nucleases above.

SEQ ID NOs: 5147-5290 show the peptide of HNH domains of MG21 nucleases above.

SEQ ID NOs: 5509 and 11176-11178 show nucleotide sequences of MG21 tracrRNAs derived from the same loci as MG21 nucleases above.

SEQ ID NOs: 5473 and 11139 show nucleotide sequences of sgRNAs engineered to function with an MG21 nuclease.

SEQ ID NO: 5585 shows a nucleotide sequence for an *E. coli* codon-optimized coding sequences for an MG21 family enzyme.

SEQ ID NOs: 5687-5692 and 5674-5675 show peptide sequences characteristic of MG21 family enzymes.

SEQ ID NOs: 9892-9951 show the peptide sequences of PAM-interacting domains of MG21 nucleases.

SEQ ID NO: 11116 shows the nucleotide sequence of a single guide PAM of an MG21 nuclease.

SEQ ID NOs: 11328-11336 show the nucleotide sequences of target sites of MG21 nucleases.

MG22

SEQ ID NOs: 1656-1755 show the full-length peptide sequences of MG22 nucleases.

SEQ ID NOs: 3475-3568 show the peptide sequences of RuvC_III domains of MG22 nucleases above.

SEQ ID NOs: 5291-5389 show the peptide of HNH domains of MG22 nucleases above.

SEQ ID NOs: 5510 and 11179-11180 show nucleotide sequences of MG22 tracrRNAs derived from the same loci as MG22 nucleases above.

SEQ ID NOs: 5474 shows the nucleotide sequence of an sgRNAs engineered to function with an MG22 nuclease.

SEQ ID NO: 5586 shows a nucleotide sequence for an *E. coli* codon-optimized coding sequences for an MG22 family enzyme.

SEQ ID NOs: 5694-5699 show peptide sequences characteristic of MG22 family enzymes.

SEQ ID NOs: 9952-9982 show the peptide sequences of PAM-interacting domains of MG22 nucleases.

SEQ ID NOs: 11337-11344 show the nucleotide sequences of target sites of MG22 nucleases.

MG23

SEQ ID NOs: 1756-1826 and 7734-7735 show the full-length peptide sequences of MG23 nucleases.

SEQ ID NOs: 3569-3637 show the peptide sequences of RuvC_III domains of MG23 nucleases above.

SEQ ID NOs: 5390-5460 show the peptide of HNH domains of MG23 nucleases above.

SEQ ID NOs: 5511 and 11181-11182 show nucleotide sequences of MG23 tracrRNAs derived from the same loci as MG23 nucleases above.

SEQ ID NOs: 5475 and 11140 show nucleotide sequences of sgRNAs engineered to function with an MG23 nuclease.

SEQ ID NO: 5587 shows a nucleotide sequence for an *E. coli* codon-optimized coding sequences for an MG23 family enzyme.

SEQ ID NOs: 5700-5717 show peptide sequences characteristic of MG23 family enzymes.

SEQ ID NOs: 9983-10004 show the peptide sequences of PAM-interacting domains of MG23 nucleases.

SEQ ID NOs: 11345-11351 show the nucleotide sequences of target sites of MG23 nucleases.

MG24

SEQ ID NOs: 7736-8027 show the full-length peptide sequences of MG24 nucleases.

SEQ ID NOs: 10005-10162 show the peptide sequences of PAM-interacting domains of MG24 nucleases.

MG25

SEQ ID NOs: 8028-8091 show the full-length peptide sequences of MG25 nucleases.

SEQ ID NOs: 10163-10211 show the peptide sequences of PAM-interacting domains of MG25 nucleases.

MG38

SEQ ID NOs: 8092-8095 show the full-length peptide sequences of MG38 nucleases.

SEQ ID NOs: 10212-10214 show the peptide sequences of PAM-interacting domains of MG38 nucleases.

MG40

SEQ ID NOs: 5718-5750 and 8096-8163 show the full-length peptide sequences of MG40 nucleases.

SEQ ID NOs: 5847-5852 show protospacer adjacent motifs associated with MG 40 nucleases.

SEQ ID NOs: 5862-5873 show the nucleotide sequence of an sgRNA engineered to function with an MG40 nuclease.

SEQ ID NOs: 10215-10263 show the peptide sequences of PAM-interacting domains of MG40 nucleases.

SEQ ID NOs: 11183-11188 show nucleotide sequences of MG40 tracrRNAs derived from the same loci as MG40 nucleases above.

MG41

SEQ ID NOs: 8164-8286 show the full-length peptide sequences of MG41 nucleases.

SEQ ID NOs: 10264-10304 show the peptide sequences of PAM-interacting domains of MG41 nucleases.

MG42

SEQ ID NOs: 8287-8356 show the full-length peptide sequences of MG42 nucleases.

SEQ ID NOs: 10305-10355 show the peptide sequences of PAM-interacting domains of MG42 nucleases.

MG43

SEQ ID NOs: 8357-8453 show the full-length peptide sequences of MG43 nucleases.

SEQ ID NOs: 10356-10412 show the peptide sequences of PAM-interacting domains of MG43 nucleases.

SEQ ID NO: 11117 shows the nucleotide sequence of a single guide PAM of an MG43 nuclease.

SEQ ID NO: 11141 shows the nucleotide sequence of an sgRNA engineered to function with an MG43 nuclease.

SEQ ID NO: 11189 shows the nucleotide sequence of an MG43 tracrRNA derived from the same loci as MG43 nucleases above.

MG44

SEQ ID NOs: 8454-8496 show the full-length peptide sequences of MG44 nucleases.

SEQ ID NOs: 10413-10555 show the peptide sequences of PAM-interacting domains of MG44 nucleases.

SEQ ID NO: 11190 shows the nucleotide sequence of an MG44 tracrRNA derived from the same loci as MG44 nucleases above.

MG46

SEQ ID NOs: 8497-8634 show the full-length peptide sequences of MG46 nucleases.

SEQ ID NOs: 10556-10633 show the peptide sequences of PAM-interacting domains of MG46 nucleases.

SEQ ID NO: 11191 shows the nucleotide sequence of an MG46 tracrRNA derived from the same loci as MG46 nucleases above.

MG47

SEQ ID NOs: 5751-5768 and 8635-8664 show the full-length peptide sequences of MG47 nucleases.

SEQ ID NOs: 5853-5854 show protospacer adjacent motifs associated with MG47 nucleases.

SEQ ID NOs: 5878-5881 show the nucleotide sequence of an sgRNA engineered to function with an MG47 nuclease.

SEQ ID NOs: 10634-10656 show the peptide sequences of PAM-interacting domains of MG47 nucleases.

SEQ ID NOs: 11192-11193 show nucleotide sequences of MG47 tracrRNAs derived from the same loci as MG47 nucleases above.

MG48

SEQ ID NOs: 5769-5804 and 8665 show the full-length peptide sequences of MG48 nucleases.

SEQ ID NOs: 5855-5856 show protospacer adjacent motifs associated with MG48 nucleases.

SEQ ID NOs: 5886, 5890, 5893, and 11194 show the nucleotide sequences of MG48 tracrRNA derived from the same loci as MG48 nucleases above SEQ ID NOs: 5887, 5891 and 5894 show CRISPR repeats associated with MG48 nucleases described herein.

SEQ ID NOs: 5888-5889, 5892 and 5895-5896 show putative sgRNA designed to function with an MG48 nuclease.

SEQ ID NOs: 10657-10662 show the peptide sequences of PAM-interacting domains of MG48 nucleases.

SEQ ID NOs: 11142-11143 show nucleotide sequences of sgRNAs engineered to function with an MG48 nuclease.

MG49

SEQ ID NOs: 5805-5823 and 8666-8677 show the full-length peptide sequences of MG49 nucleases.

SEQ ID NOs: 5857-5858 show protospacer adjacent motifs associated with MG49 nucleases.

SEQ ID NOs: 5862-5873 show the nucleotide sequence of an sgRNA engineered to function with an MG40 nuclease.

SEQ ID NOs: 5876-5877 show the nucleotide sequence of an sgRNA engineered to function with an MG49 nuclease.

SEQ ID NOs: 10663-10675 show the peptide sequences of PAM-interacting domains of MG49 nucleases.

SEQ ID NOs: 11195-11196 show nucleotide sequences of MG49 tracrRNAs derived from the same loci as MG49 nucleases above.

MG50

SEQ ID NOs: 5824-5826 and 8678-8682 show the full-length peptide sequences of MG50 nucleases.

SEQ ID NO: 5859 shows a protospacer adjacent motif associated with MG50 nucleases.

SEQ ID NOs: 5884-5885 show the nucleotide sequence of an sgRNA engineered to function with an MG50 nuclease.

SEQ ID NOs: 10676-10682 show the peptide sequences of PAM-interacting domains of MG50 nucleases.

SEQ ID NO: 11197 shows the nucleotide sequence of an MG50 tracrRNA derived from the same loci as MG50 nucleases above.

MG51

SEQ ID NOs: 5827-5830 and 8683-8705 show the full-length peptide sequences of MG51 nucleases.

SEQ ID NO: 5860 shows a protospacer adjacent motif associated with MG51 nucleases.

SEQ ID NOs: 5882-5883 show the nucleotide sequence of an sgRNA engineered to function with an MG51 nuclease.

SEQ ID NOs: 10683-10704 show the peptide sequences of PAM-interacting domains of MG51 nucleases.

SEQ ID NO: 11198 shows the nucleotide sequence of an MG51 tracrRNA derived from the same loci as MG51 nucleases above.

MG52

SEQ ID NOs: 5831-5846 and 8706 show the full-length peptide sequences of MG52 nucleases.

SEQ ID NO: 5861 shows a protospacer adjacent motif associated with MG52 nucleases.

SEQ ID NOs: 5874-5875 show the nucleotide sequence of an sgRNA engineered to function with an MG52 nuclease.

SEQ ID NOs: 10705-10710 show the peptide sequences of PAM-interacting domains of MG52 nucleases.

SEQ ID NO: 11199 shows the nucleotide sequence of an MG52 tracrRNA derived from the same loci as MG52 nucleases above.

MG71

SEQ ID NOs: 10711-10712 show the peptide sequences of PAM-interacting domains of MG71 nucleases.

SEQ ID NOs: 11144-11145 show nucleotide sequences of sgRNAs engineered to function with an MG71 nuclease.

SEQ ID NOs: 11200-11201 show nucleotide sequences of MG71 tracrRNAs derived from the same loci as MG71 nucleases above.

MG72

SEQ ID NO: 11202 shows the nucleotide sequence of an MG72 tracrRNA derived from the same loci as MG72 nucleases above.

MG73

SEQ ID NOs: 10713-10718 show the peptide sequences of PAM-interacting domains of MG73 nucleases.

SEQ ID NOs: 11203-11204 show nucleotide sequences of MG73 tracrRNAs derived from the same loci as MG73 nucleases above.

MG74

SEQ ID NOs: 10719-10732 show the peptide sequences of PAM-interacting domains of MG74 nucleases.

SEQ ID NO: 11205 shows the nucleotide sequence of an MG74 tracrRNA derived from the same loci as MG74 nucleases above.

MG86

SEQ ID NOs: 8707-8737 show the full-length peptide sequences of MG86 nucleases.

SEQ ID NOs: 10733-10791 show the peptide sequences of PAM-interacting domains of MG86 nucleases.

SEQ ID NO: 11118 shows the nucleotide sequence of a single guide PAM of an MG86 nuclease.

SEQ ID NOs: 11206-11207 show nucleotide sequences of MG86 tracrRNAs derived from the same loci as MG86 nucleases above.

MG87

SEQ ID NOs: 8738-8747 show the full-length peptide sequences of MG87 nucleases.

SEQ ID NOs: 10792-10828 show the peptide sequences of PAM-interacting domains of MG87 nucleases.

SEQ ID NOs: 11208-11210 show nucleotide sequences of MG87 tracrRNAs derived from the same loci as MG87 nucleases above.

MG88

SEQ ID NOs: 10829-10841 show the peptide sequences of PAM-interacting domains of MG88 nucleases.

SEQ ID NOs: 11211-11213 show nucleotide sequences of MG88 tracrRNAs derived from the same loci as MG88 nucleases above.

MG89

SEQ ID NOs: 10842-10854 show the peptide sequences of PAM-interacting domains of MG89 nucleases.

SEQ ID NOs: 11214-11215 show nucleotide sequences of MG89 tracrRNAs derived from the same loci as MG89 nucleases above.

MG94

SEQ ID NOs: 8748-8781 show the full-length peptide sequences of MG94 nucleases.

SEQ ID NOs: 10855-10860 show the peptide sequences of PAM-interacting domains of MG94 nucleases.

SEQ ID NOs: 11119-11120 show the nucleotide sequences of single guide PAMs of MG94 nucleases.

SEQ ID NOs: 11146-11147 show nucleotide sequences of sgRNAs engineered to function with an MG94 nuclease.

SEQ ID NOs: 11216-11217 show nucleotide sequences of MG94 tracrRNAs derived from the same loci as MG94 nucleases above.

MG95

SEQ ID NOs: 8782-8785 show the full-length peptide sequences of MG95 nucleases.

SEQ ID NOs: 10861-10863 show the peptide sequences of PAM-interacting domains of MG95 nucleases.

SEQ ID NOs: 11121-11122 show the nucleotide sequences of single guide PAMs of MG95 nucleases.

SEQ ID NOs: 11148-11149 show nucleotide sequences of sgRNAs engineered to function with an MG95 nuclease.

SEQ ID NOs: 11218-11219 show nucleotide sequences of MG95 tracrRNAs derived from the same loci as MG95 nucleases above.

MG96

SEQ ID NOs: 8786-8814 show the full-length peptide sequences of MG96 nucleases.

SEQ ID NOs: 10864-10884 show the peptide sequences of PAM-interacting domains of MG96 nucleases.

SEQ ID NO: 11123 shows the nucleotide sequence of a single guide PAM of an MG96 nuclease.

SEQ ID NO: 11150 shows the nucleotide sequence of an sgRNA engineered to function with an MG96 nuclease.

SEQ ID NO: 11220 shows the nucleotide sequence of an MG96 tracrRNA derived from the same loci as MG96 nucleases above.

MG97

SEQ ID NOs: 8815-8818 show the full-length peptide sequences of MG97 nucleases.

SEQ ID NOs: 10885-10887 show the peptide sequences of PAM-interacting domains of MG97 nucleases.

MG98

SEQ ID NOs: 8819-8959 show the full-length peptide sequences of MG98 nucleases.

SEQ ID NOs: 10888-10936 show the peptide sequences of PAM-interacting domains of MG98 nucleases.

SEQ ID NOs: 11124-11125 show the nucleotide sequences of single guide PAMs of MG98 nucleases.

SEQ ID NOs: 11151-11152 show nucleotide sequences of sgRNAs engineered to function with an MG98 nuclease.

SEQ ID NOs: 11221-11222 show nucleotide sequences of MG98 tracrRNAs derived from the same loci as MG98 nucleases above.

MG99

SEQ ID NO: 11153 shows the nucleotide sequence of an sgRNA engineered to function with an MG99 nuclease.

SEQ ID NO: 11223 shows the nucleotide sequence of an MG99 tracrRNA derived from the same loci as MG99 nucleases above.

MG100

SEQ ID NOs: 8960-9036 show the full-length peptide sequences of MG100 nucleases.

SEQ ID NOs: 10937-10991 show the peptide sequences of PAM-interacting domains of MG100 nucleases.

SEQ ID NO: 11126 shows the nucleotide sequence of a single guide PAM of an MG100 nuclease.

SEQ ID NOs: 11154-11155 show nucleotide sequences of sgRNAs engineered to function with an MG100 nuclease.

SEQ ID NOs: 11224-11225 show nucleotide sequences of MG100 tracrRNAs derived from the same loci as MG100 nucleases above.

MG111

SEQ ID NOs: 9037-9126 show the full-length peptide sequences of MG111 nucleases.

SEQ ID NOs: 10992-11046 show the peptide sequences of PAM-interacting domains of MG111 nucleases.

SEQ ID NOs: 11127-11128 show the nucleotide sequences of single guide PAMs of MG111 nucleases.

SEQ ID NOs: 11156-11157 show nucleotide sequences of sgRNAs engineered to function with an MG111 nuclease.

SEQ ID NOs: 11226-11227 show nucleotide sequences of MG111 tracrRNAs derived from the same loci as MG111 nucleases above.

MG112

SEQ ID NOs: 9127-9149 show the full-length peptide sequences of MG112 nucleases.

SEQ ID NOs: 11047-11062 show the peptide sequences of PAM-interacting domains of MG112 nucleases.

MG116

SEQ ID NOs: 9150-9191 show the full-length peptide sequences of MG116 nucleases.

SEQ ID NOs: 11063-11098 show the peptide sequences of PAM-interacting domains of MG116 nucleases.

SEQ ID NO: 11129 shows the nucleotide sequence of a single guide PAM of an MG116 nuclease.

SEQ ID NO: 11158 shows the nucleotide sequence of an sgRNA engineered to function with an MG116 nuclease.

SEQ ID NO: 11228 shows the nucleotide sequence of an MG116 tracrRNA derived from the same loci as MG116 nucleases above.

MG123

SEQ ID NOs: 11617-11624 show the full-length peptide sequences of MG123 nucleases.

SEQ ID NO: 11518 shows the nucleotide sequence of a single guide PAM of an MG123 nuclease.

SEQ ID NO: 11555 shows the nucleotide sequence of an sgRNA engineered to function with an MG123 nuclease.

MG124

SEQ ID NOs: 11625-11626 show the full-length peptide sequences of MG124 nucleases.

SEQ ID NO: 11519 shows the nucleotide sequence of a single guide PAM of an MG124 nuclease.

SEQ ID NO: 11556 shows the nucleotide sequence of an sgRNA engineered to function with an MG124 nuclease.

MG125

SEQ ID NOs: 11627-11707 show the full-length peptide sequences of MG125 nucleases.

SEQ ID NOs: 11520-11524 show the nucleotide sequences of single guide PAMs of MG125 nucleases.

SEQ ID NOs: 11557-11561 show the nucleotide sequences of sgRNAs engineered to function with MG125 nucleases.

MG150

SEQ ID NOs: 7359-7368 and 11708-11710 show the full-length peptide sequences of MG150 nucleases.

SEQ ID NOs: 11525-11529 show the nucleotide sequences of single guide PAMs of MG150 nucleases.

SEQ ID NOs: 11562-11566 show the nucleotide sequences of sgRNAs engineered to function with MG150 nucleases.

B2M Targeting

SEQ ID NOs: 6305-6386 show the nucleotide sequences of sgRNAs engineered to function with an MG3-6 nuclease in order to target B2M.

SEQ ID NOs: 6387-6468 show the DNA sequences of B2M target sites.

TRAC Targeting

SEQ ID NOs: 6469-6508 and 6804 show the nucleotide sequences of sgRNAs engineered to function with an MG3-6 nuclease in order to target TRAC.

SEQ ID NOs: 6509-6548 and 6805 show the DNA sequences of TRAC target sites. HPRT Targeting SEQ ID NOs: 6549-6615 show the nucleotide sequences of sgRNAs engineered to function with an MG3-6 nuclease in order to target HPRT.

SEQ ID NOs: 6616-6682 show the DNA sequences of HPRT target sites.

MG3-6 TRBC1/2 Targeting

SEQ ID NOs: 6683-6721 show the nucleotide sequences of sgRNAs engineered to function with an MG3-6 nuclease in order to target TRBC1/2.

SEQ ID NOs: 6722-6760 show the DNA sequences of TRBC1/2 target sites.

MG3-8 TRBC1/2 Targeting

SEQ ID NOs: 6761-6781 show the nucleotide sequences of sgRNAs engineered to function with an MG3-8 nuclease in order to target TRBC1/2.

SEQ ID NOs: 6782-6802 show the DNA sequences of TRBC1/2 target sites.

MG3-6 CD2 Targeting

SEQ ID NOs: 6811-6852 show the nucleotide sequences of sgRNAs engineered to function with an MG3-6 nuclease in order to target CD2.

SEQ ID NOs: 6853-6894 show the DNA sequences of CD2 target sites.

MG3-6 CD5 Targeting

SEQ ID NOs: 6895-6958 show the nucleotide sequences of sgRNAs engineered to function with an MG3-6 nuclease in order to target CD5.

SEQ ID NOs: 6959-7022 show the DNA sequences of CD5 target sites.

MG3-6 FAS Targeting

SEQ ID NOs: 7023-7056 show the nucleotide sequences of sgRNAs engineered to function with an MG3-6 nuclease in order to target FAS.

SEQ ID NOs: 7057-7090 show the DNA sequences of FAS target sites.

MG3-6 PD-1 Targeting

SEQ ID NOs: 7091-7128 show the nucleotide sequences of sgRNAs engineered to function with an MG3-6 nuclease in order to target PD-1.

SEQ ID NOs: 7129-7166 show the DNA sequences of PD-1 target sites.

MG3-6 hRosa26 Targeting

SEQ ID NOs: 7167-7198 show the nucleotide sequences of sgRNAs engineered to function with an MG3-6 nuclease in order to target hRosa26.

SEQ ID NOs: 7199-7230 show the DNA sequences of hRosa26 target sites.

MG21-1 TRAC Targeting

SEQ ID NOs: 7231-7234 show the nucleotide sequences of sgRNAs engineered to function with an MG21-1 nuclease in order to target TRAC.

SEQ ID NOs: 7235-7238 show the DNA sequences of TRAC target sites.

MG23-1 TRAC Targeting

SEQ ID NOs: 7239-7247 show the nucleotide sequences of sgRNAs engineered to function with an MG23-1 nuclease in order to target TRAC.

SEQ ID NOs: 7248-7256 show the DNA sequences of TRAC target sites.

MG14-241 AAVS1 Targeting

SEQ ID NOs: 11508-11510 show the nucleotide sequences of sgRNAs engineered to function with an MG14-241 nuclease in order to target AAVS1.

SEQ ID NOs: 11511-11513 show the DNA sequences of AAVS1 target sites.

MG23-1 AAVS1 Targeting

SEQ ID NOs: 7257-7260 show the nucleotide sequences of sgRNAs engineered to function with an MG23-1 nuclease in order to target AAVS1.

SEQ ID NOs: 7261-7264 show the DNA sequences of AAVS1 target sites.

MG71-2 AAVS1 Targeting

SEQ ID NOs: 7265-7266 show the nucleotide sequences of sgRNAs engineered to function with an MG71-2 nuclease in order to target AAVS1.

SEQ ID NOs: 7267-7268 show the DNA sequences of AAVS1 target sites.

MG73-1 TRAC Targeting

SEQ ID NO: 7269 shows the nucleotide sequence of an sgRNA engineered to function with an MG73-1 nuclease in order to target TRAC.

SEQ ID NO: 7270 shows the DNA sequence of a TRAC target site.

MG89-2 TRAC Targeting

SEQ ID NOs: 7271-7277 show the nucleotide sequences of sgRNAs engineered to function with an MG89-2 nuclease in order to target TRAC.

SEQ ID NOs: 7278-7284 show the DNA sequences of TRAC target sites.

MG99-1 TRAC Targeting

SEQ ID NOs: 11514-11515 show the nucleotide sequences of sgRNAs engineered to function with an MG99-1 nuclease in order to target TRAC.

SEQ ID NOs: 11516-11517 show the DNA sequences of TRAC target sites.

MG3-6 Human HAO-1 Targeting

SEQ ID NOs: 11352-11372 show the nucleotide sequences of sgRNAs engineered to function with an MG3-6 nuclease in order to target human HAO-1.

MG3-6 human GPR146 Targeting

SEQ ID NOs: 11374-11405 show the nucleotide sequences of sgRNAs engineered to function with an MG3-6 nuclease in order to target human GPR146.

SEQ ID NOs: 11406-11437 show the DNA sequences of human GPR146 target sites.

MG3-6 mouse GPR146 Targeting

SEQ ID NOs: 11438-11472 show the nucleotide sequences of sgRNAs engineered to function with an MG3-6 nuclease in order to target mouse GPR146.

SEQ ID NOs: 11473-11507 show the DNA sequences of mouse GPR146 target sites.

DETAILED DESCRIPTION

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

The practice of some methods disclosed herein employ, unless otherwise indicated, techniques of immunology, biochemistry, chemistry, molecular biology, microbiology, cell biology, genomics and recombinant DNA. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)) (which is entirely incorporated by reference herein).

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising".

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

As used herein, a "cell" generally refers to a biological cell. A cell may be the basic structural, functional or biological unit of a living organism. A cell may originate from any organism having one or more cells. Some non-limiting examples include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, *Cannabis*, tobacco, flowering plants, conifers, gymnosperms, ferns, clubmosses, hornworts, liverworts, mosses), an algal cell, (e.g., *Botryococcus braunii, Chlamydomonas reinhardtii, Nannochloropsis gaditana, Chlorella pyrenoidosa, Sargassum patens* C. Agardh, and the like), seaweeds (e.g., kelp), a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), and etcetera. Sometimes a cell is not originating from a natural organism (e.g., a cell can be a synthetically made, sometimes termed an artificial cell).

The term "nucleotide," as used herein, generally refers to a base-sugar-phosphate combination. A nucleotide may comprise a synthetic nucleotide. A nucleotide may comprise a synthetic nucleotide analog. Nucleotides may be monomeric units of a nucleic acid sequence (e.g., deoxyribonucleic acid (DNA) and ribonucleic acid (RNA)). The term nucleotide may include ribonucleoside triphosphates adenosine triphosphate (ATP), uridine triphosphate (UTP), cytosine triphosphate (CTP), guanosine triphosphate (GTP) and deoxyribonucleoside triphosphates such as dATP, dCTP, dITP, dUTP, dGTP, dTTP, or derivatives thereof. Such derivatives may include, for example, [αS]dATP, 7-deaza-dGTP and 7-deaza-dATP, and nucleotide derivatives that confer nuclease resistance on the nucleic acid molecule containing them. The term nucleotide as used herein may refer to dideoxyribonucleoside triphosphates (ddNTPs) and their derivatives. Illustrative examples of dideoxyribonucleoside triphosphates may include, but are not limited to, ddATP, ddCTP, ddGTP, ddITP, and ddTTP. A nucleotide may be unlabeled or detectably labeled, such as using moieties comprising optically detectable moieties (e.g., fluorophores). Labeling may also be carried out with quantum dots. Detectable labels may include, for example, radioactive isotopes, fluorescent labels, chemiluminescent labels, bioluminescent labels and enzyme labels. Fluorescent labels of nucleotides may include but are not limited fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4'dimethylaminophenylazo) benzoic acid (DABCYL), Cascade Blue, Oregon Green, Texas Red, Cyanine and 5-(2'-aminoethyl) aminonaphthalene-1-sulfonic acid (EDANS). Specific examples of fluorescently labeled nucleotides can include [R6G]dUTP, [TAMRA]dUTP, [RI 10]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G] ddATP, [dR110]ddCTP, [dTAMRA]ddGTP, and [dROX] ddTTP available from Perkin Elmer, Foster City, Calif; FluoroLink DeoxyNucleotides, FluoroLink Cy3-dCTP, FluoroLink Cy5-dCTP, FluoroLink Fluor X-dCTP, FluoroLink Cy3-dUTP, and FluoroLink Cy5-dUTP available from Amersham, Arlington Heights, Ill.; Fluorescein-15-dATP, Fluorescein-12-dUTP, Tetramethyl-rodamine-6-dUTP, IR770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP available from Molecular Probes, Eugene, Oreg. Nucleotides can also be labeled or marked by chemical modification. A chemically-modified single nucleotide can be biotin-dNTP. Some non-limiting examples of biotinylated dNTPs can include, biotin-dATP (e.g., bio-N6-ddATP, biotin-14-dATP), biotin-dCTP (e.g., biotin-11-dCTP, biotin-14-dCTP), and biotin-dUTP (e.g., biotin-11-dUTP, biotin-16-dUTP, biotin-20-dUTP).

The terms "polynucleotide," "oligonucleotide," and "nucleic acid" are used interchangeably to generally refer to a polymeric form of nucleotides of any length, either deoxyribonucleotides or ribonucleotides, or analogs thereof, either in single-, double-, or multi-stranded form. A polynucleotide may be exogenous or endogenous to a cell. A polynucleotide may exist in a cell-free environment. A polynucleotide may be a gene or fragment thereof. A polynucleotide may be DNA. A polynucleotide may be RNA. A polynucleotide may have any three-dimensional structure and may perform any function. A polynucleotide may comprise one or more analogs (e.g., altered backbone, sugar, or nucleobase). If present, modifications to the nucleotide structure may be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g., rhodamine or fluorescein linked to the sugar), thiol containing nucleotides, biotin linked nucleotides, fluorescent base analogs, CpG islands, methyl-7-guanosine, methylated nucleotides, inosine, thiouridine, pseudourdine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes, and primers. The sequence of nucleotides may be interrupted by non-nucleotide components.

The terms "transfection" or "transfected" generally refer to introduction of a nucleic acid into a cell by non-viral or viral-based methods. The nucleic acid molecules may be gene sequences encoding complete proteins or functional portions thereof. See, e.g., Sambrook et al., 1989, Molecular Cloning: A Laboratory Manual, 18.1-18.88.

The terms "peptide," "polypeptide," and "protein" are used interchangeably herein to generally refer to a polymer of at least two amino acid residues joined by peptide bond(s). This term does not connote a specific length of polymer, nor is it intended to imply or distinguish whether the peptide is produced using recombinant techniques, chemical or enzymatic synthesis, or is naturally occurring. The terms apply to naturally occurring amino acid polymers as well as amino acid polymers comprising at least one modified amino acid. In some cases, the polymer may be interrupted by non-amino acids. The terms include amino acid chains of any length, including full length proteins, and proteins with or without secondary or tertiary structure (e.g., domains). The terms also encompass an amino acid polymer that has been modified, for example, by disulfide bond formation, glycosylation, lipidation, acetylation, phosphorylation, oxidation, and any other manipulation such as conjugation with a labeling component. The terms "amino acid" and "amino acids," as used herein, generally refer to natural and non-natural amino acids, including, but not limited to, modified amino acids and amino acid analogues. Modified amino acids may include natural amino acids and non-natural amino acids, which have been chemically modified to include a group or a chemical moiety not naturally present on the amino acid. Amino acid analogues may refer to amino acid derivatives. The term "amino acid" includes both D-amino acids and L-amino acids.

As used herein, the "non-native" can generally refer to a nucleic acid or polypeptide sequence that is not found in a native nucleic acid or protein. Non-native may refer to affinity tags. Non-native may refer to fusions. Non-native may refer to a naturally occurring nucleic acid or polypeptide sequence that comprises mutations, insertions or deletions. A non-native sequence may exhibit or encode for an activity (e.g., enzymatic activity, methyltransferase activity, acetyltransferase activity, kinase activity, ubiquitinating activity, etc.) that may also be exhibited by the nucleic acid or polypeptide sequence to which the non-native sequence is fused. A non-native nucleic acid or polypeptide sequence may be linked to a naturally-occurring nucleic acid or polypeptide sequence (or a variant thereof) by genetic engineering to generate a chimeric nucleic acid or polypeptide sequence encoding a chimeric nucleic acid or polypeptide.

The term "promoter", as used herein, generally refers to the regulatory DNA region which controls transcription or expression of a gene, and which may be located adjacent to or overlapping a nucleotide or region of nucleotides at which RNA transcription is initiated. A promoter may contain specific DNA sequences which bind protein factors, often referred to as transcription factors, which facilitate binding of RNA polymerase to the DNA leading to gene transcription. A 'basal promoter', also referred to as a 'core promoter', may generally refer to a promoter that contains all the basic elements to promote transcriptional expression of an operably linked polynucleotide. Eukaryotic basal promoters often contain a TATA-box or a CAAT box.

The term "expression", as used herein, generally refers to the process by which a nucleic acid sequence or a polynucleotide is transcribed from a DNA template (such as into mRNA or other RNA transcript) or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof generally refer to juxtaposition of genetic elements, e.g., a promoter, an enhancer, a polyadenylation sequence, etc., wherein the elements are in a relationship permitting them to operate in the expected manner. For instance, a regulatory element, which may comprise promoter or enhancer sequences, is operatively linked to a coding region if the regulatory element helps initiate transcription of the coding sequence. There may be intervening residues between the regulatory element and coding region so long as this functional relationship is maintained.

A "vector" as used herein, generally refers to a macromolecule or association of macromolecules that comprises or associates with a polynucleotide and which may be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably generally to refer to a combination of nucleic acid sequences or elements that are expressed together or are operably linked for expression. In some cases, an expression cassette refers to the combination of regulatory elements and a gene or genes to which they are operably linked for expression.

A "functional fragment" of a DNA or protein sequence generally refers to a fragment that retains a biological activity (either functional or structural) that is substantially similar to a biological activity of the full-length DNA or protein sequence. A biological activity of a DNA sequence may be its ability to influence expression in a manner attributed to the full-length sequence.

As used herein, an "engineered" object generally indicates that the object has been modified by human intervention. According to non-limiting examples: a nucleic acid may be modified by changing its sequence to a sequence that does not occur in nature; a nucleic acid may be modified by ligating it to a nucleic acid that it does not associate with in nature such that the ligated product possesses a function not present in the original nucleic acid; an engineered nucleic acid may synthesized in vitro with a sequence that does not exist in nature; a protein may be modified by changing its amino acid sequence to a sequence that does not exist in nature; an engineered protein may acquire a new function or property. An "engineered" system comprises at least one engineered component.

As used herein, "synthetic" and "artificial" are used interchangeably to refer to a protein or a domain thereof that has low sequence identity (e.g., less than 50% sequence identity, less than 25% sequence identity, less than 10% sequence identity, less than 5% sequence identity, less than 1% sequence identity) to a naturally occurring human protein. For example, VPR and VP64 domains are synthetic transactivation domains.

The term "tracrRNA" or "tracr sequence", as used herein, can generally refer to a nucleic acid with at least about 5%, 10%, 20%, 30%, 40%, 50%, 60%, 70%, 80%, 90%, 95%, or 100% sequence identity or sequence similarity to a wild type exemplary tracrRNA sequence (e.g., a tracrRNA from *S. pyogenes S. aureus*, etc or SEQ ID NOs: 5476-5511). tracrRNA can refer to a nucleic acid with at most about 5%, 10%, 20%, 30%, 40%, 50%, 60%, 70%, 80%, 90%, or 100% sequence identity or sequence similarity to a wild type exemplary tracrRNA sequence (e.g., a tracrRNA from *S. pyogenes S. aureus*, etc). tracrRNA may refer to a modified form of a tracrRNA that can comprise a nucleotide change such as a deletion, insertion, or substitution, variant, mutation, or chimera. A tracrRNA may refer to a nucleic acid that can be at least about 60% identical to a wild type exemplary tracrRNA (e.g., a tracrRNA from *S. pyogenes S. aureus*, etc) sequence over a stretch of at least 6 contiguous nucleotides. For example, a tracrRNA sequence can be at least about 60% identical, at least about 65% identical, at least about 70% identical, at least about 75% identical, at least about 80% identical, at least about 85% identical, at least about 90% identical, at least about 95% identical, at least about 98% identical, at least about 99% identical, or 100% identical to a wild type exemplary tracrRNA (e.g., a tracrRNA from *S. pyogenes S. aureus*, etc) sequence over a stretch of at least 6 contiguous nucleotides. Type II tracrRNA sequences can be predicted on a genome sequence by identifying regions with complementarity to part of the repeat sequence in an adjacent CRISPR array.

As used herein, a "guide nucleic acid" can generally refer to a nucleic acid that may hybridize to another nucleic acid. A guide nucleic acid may be RNA. A guide nucleic acid may be DNA. The guide nucleic acid may be programmed to bind to a sequence of nucleic acid site-specifically. The nucleic acid to be targeted, or the target nucleic acid, may comprise nucleotides. The guide nucleic acid may comprise nucleotides. A portion of the target nucleic acid may be complementary to a portion of the guide nucleic acid. The strand of a double-stranded target polynucleotide that is complementary to and hybridizes with the guide nucleic acid may be called the complementary strand. The strand of the double-stranded target polynucleotide that is complementary to the complementary strand, and therefore may not be complementary to the guide nucleic acid may be called noncomplementary strand. A guide nucleic acid may comprise a polynucleotide chain and can be called a "single guide nucleic acid." A guide nucleic acid may comprise two polynucleotide chains and may be called a "double guide nucleic acid." If not otherwise specified, the term "guide nucleic acid" may be inclusive, referring to both single guide nucleic acids and double guide nucleic acids. A guide nucleic acid may comprise a segment that can be referred to as a "nucleic acid-targeting segment" or a "nucleic acid-targeting sequence." A nucleic acid-targeting segment may comprise a sub-segment that may be referred to as a "protein binding segment" or "protein binding sequence" or "Cas protein binding segment".

The term "sequence identity" or "percent identity" in the context of two or more nucleic acids or polypeptide sequences, generally refers to two (e.g., in a pairwise alignment) or more (e.g., in a multiple sequence alignment) sequences that are the same or have a specified percentage of amino acid residues or nucleotides that are the same, when compared and aligned for maximum correspondence over a local or global comparison window, as measured using a sequence comparison algorithm. Suitable sequence comparison algorithms for polypeptide sequences include, e.g., BLASTP using parameters of a wordlength (W) of 3, an expectation I of 10, and the BLOSUM62 scoring matrix setting gap costs at existence of 11, extension of 1, and using a conditional compositional score matrix adjustment for polypeptide sequences longer than 30 residues; BLASTP using parameters of a wordlength (W) of 2, an expectation (E) of 1000000, and the PAM30 scoring matrix setting gap costs at 9 to open gaps and 1 to extend gaps for sequences of less than 30 residues (these are the default parameters for BLASTP in the BLAST suite available at https://blast.ncbi.nlm.nih.gov); CLUSTALW with parameters of; the Smith-Waterman homology search algorithm with parameters of a match of 2, a mismatch of −1, and a gap of −1; MUSCLE with default parameters; MAFFT with parameters retree of 2 and maxiterations of 1000; Novafold with default parameters; HMMER hmmalign with default parameters.

Included in the current disclosure are variants of any of the enzymes described herein with one or more conservative amino acid substitutions. Such conservative substitutions can be made in the amino acid sequence of a polypeptide without disrupting the three-dimensional structure or function of the polypeptide. Conservative substitutions can be accomplished by substituting amino acids with similar hydrophobicity, polarity, and R chain length for one another. Additionally or alternatively, by comparing aligned sequences of homologous proteins from different species, conservative substitutions can be identified by locating amino acid residues that have been mutated between species (e.g. non-conserved residues) without altering the basic functions of the encoded proteins. Such conservatively substituted variants may include variants with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of the endonuclease protein sequences described herein (e.g. MG1, MG2, MG3, MG3a, MG3b, MG4, MG5, MG6, MG7, MG14, MG15, MG16, MG17, MG18, MG21, MG22, MG23, MG24, MG25, MG38, MG40, MG41, MG42, MG43, MG44, MG46, MG47, MG48, MG49, MG50, MG51, MG52, MG71, MG72, MG73, MG74, MG86, MG87, MG88, MG89, MG94, MG95, MG96, MG97, MG98, MG99, MG100, MG111, MG112, MG116, MG123, MG124, MG125, or MG150 family endonucleases described herein). In some embodiments, such conservatively substituted variants are functional variants. Such functional variants can encompass sequences with substitutions such that the activity of critical active site residues of the endonuclease are not disrupted. In some embodiments, a functional variant of any of the proteins described herein lacks substitution of at least one conserved or functional residue.

Conservative substitution tables providing functionally similar amino acids are available from a variety of references (see, for e.g., Creighton, Proteins: Structures and Molecular Properties (W H Freeman & Co.; 2nd edition (December 1993)). The following eight groups each contain amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)

Also included in the current disclosure are variants of any of the nucleic acid sequences described herein with one or more substitutions. Such variants may include variants with at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of the nucleic acid sequences described herein.

As used herein, the term "RuvC_III domain" generally refers to a third discontinuous segment of a RuvC endonuclease domain (the RuvC nuclease domain being comprised of three discontiguous segments, RuvC_I, RuvC_II, and RuvC_III). A RuvC domain or segments thereof can generally be identified by alignment to documented domain sequences, structural alignment to proteins with annotated domains, or by comparison to Hidden Markov Models (HMMs) built based on documented domain sequences (e.g., Pfam HMM PF18541 for RuvC_III).

As used herein, the term "HNH domain" generally refers to an endonuclease domain having characteristic histidine and asparagine residues. An HNH domain can generally be identified by alignment to documented domain sequences, structural alignment to proteins with annotated domains, or by comparison to Hidden Markov Models (HMMs) built based on documented domain sequences (e.g., Pfam HMM PF01844 for domain HNH).

Overview

The discovery of new Cas enzymes with unique functionality and structure may offer the potential to further disrupt deoxyribonucleic acid (DNA) editing technologies, improving speed, specificity, functionality, and ease of use. Relative to the predicted prevalence of Clustered Regularly Interspaced Short Palindromic Repeats (CRISPR) systems in microbes and the sheer diversity of microbial species, relatively few functionally characterized CRISPR/Cas enzymes exist in the literature. This is partly because a huge number of microbial species may not be readily cultivated in laboratory conditions. Metagenomic sequencing from natural environmental niches that represent large numbers of microbial species may offer the potential to drastically increase the number of new CRISPR/Cas systems documented and speed the discovery of new oligonucleotide editing functionalities. A recent example of the fruitfulness of such an approach is demonstrated by the 2016 discovery of CasX/CasY CRISPR systems from metagenomic analysis of natural microbial communities.

CRISPR/Cas systems are RNA-directed nuclease complexes that have been described to function as an adaptive immune system in microbes. In their natural context, CRISPR/Cas systems occur in CRISPR (clustered regularly interspaced short palindromic repeats) operons or loci, which generally comprise two parts: (i) an array of short repetitive sequences (30-40 bp) separated by equally short spacer sequences, which encode the RNA-based targeting element; and (ii) ORFs encoding the Cas encoding the nuclease polypeptide directed by the RNA-based targeting element alongside accessory proteins/enzymes. Efficient nuclease targeting of a particular target nucleic acid sequence generally requires both (i) complementary hybridization between the first 6-8 nucleic acids of the target (the target seed) and the crRNA guide; and (ii) the presence of a protospacer-adjacent motif (PAM) sequence within a defined vicinity of the target seed (the PAM usually being a sequence not commonly represented within the host genome). Depending on the exact function and organization of the system, CRISPR-Cas systems are commonly organized into 2 classes, 5 types and 16 subtypes based on shared functional characteristics and evolutionary similarity.

Class I CRISPR-Cas systems have large, multisubunit effector complexes, and comprise Types I, III, and IV.

Type I CRISPR-Cas systems are considered of moderate complexity in terms of components. In Type I CRISPR-Cas systems, the array of RNA-targeting elements is transcribed as a long precursor crRNA (pre-crRNA) that is processed at repeat elements to liberate short, mature crRNAs that direct the nuclease complex to nucleic acid targets when they are followed by a suitable short consensus sequence called a protospacer-adjacent motif (PAM). This processing occurs via an endoribonuclease subunit (Cas6) of a large endonuclease complex called Cascade, which also comprises a nuclease (Cas3) protein component of the crRNA-directed nuclease complex. Cas I nucleases function primarily as DNA nucleases.

Type III CRISPR systems may be characterized by the presence of a central nuclease, known as Cas10, alongside a repeat-associated mysterious protein (RAMP) that comprises Csm or Cmr protein subunits. Like in Type I systems, the mature crRNA is processed from a pre-crRNA using a Cas6-like enzyme. Unlike type I and II systems, type III systems appear to target and cleave DNA-RNA duplexes (such as DNA strands being used as templates for an RNA polymerase).

Type IV CRISPR-Cas systems possess an effector complex that consists of a highly reduced large subunit nuclease (csf1), two genes for RAMP proteins of the Cas5 (csf3) and Cas7 (csf2) groups, and, in some cases, a gene for a predicted small subunit; such systems are commonly found on endogenous plasmids.

Class II CRISPR-Cas systems generally have single-polypeptide multidomain nuclease effectors, and comprise Types II, V and VI.

Type II CRISPR-Cas systems are considered the simplest in terms of components. In Type II CRISPR-Cas systems, the processing of the CRISPR array into mature crRNAs does not require the presence of a special endonuclease subunit, but rather a small trans-encoded crRNA (tracrRNA) with a region complementary to the array repeat sequence; the tracrRNA interacts with both its corresponding effector nuclease (e.g. Cas9) and the repeat sequence to form a precursor dsRNA structure, which is cleaved by endogenous RNAse III to generate a mature effector enzyme loaded with both tracrRNA and crRNA. Cas II nucleases are known as DNA nucleases. Type 2 effectors generally exhibit a structure consisting of a RuvC-like endonuclease domain that adopts the RNase H fold with an unrelated HNH nuclease domain inserted within the folds of the RuvC-like nuclease domain. The RuvC-like domain is responsible for the cleavage of the target (e.g., crRNA complementary) DNA strand, while the HNH domain is responsible for cleavage of the displaced DNA strand.

Type V CRISPR-Cas systems are characterized by a nuclease effector (e.g. Cas12) structure similar to that of Type II effectors, comprising a RuvC-like domain. Similar to Type II, most (but not all) Type V CRISPR systems use a tracrRNA to process pre-crRNAs into mature crRNAs; however, unlike Type II systems which requires RNAse III to cleave the pre-crRNA into multiple crRNAs, type V systems are capable of using the effector nuclease itself to cleave pre-crRNAs. Like Type-II CRISPR-Cas systems, Type V CRISPR-Cas systems are again known as DNA nucleases. Unlike Type II CRISPR-Cas systems, some Type V enzymes (e.g., Cas12a) appear to have a robust single-stranded nonspecific deoxyribonuclease activity that is activated by the first crRNA directed cleavage of a double-stranded target sequence.

Type VI CRIPSR-Cas systems have RNA-guided RNA endonucleases. Instead of RuvC-like domains, the single polypeptide effector of Type VI systems (e.g. Cas13) comprises two HEPN ribonuclease domains. Differing from both Type II and V systems, Type VI systems also appear to not require a tracrRNA for processing of pre-crRNA into crRNA. Similar to type V systems, however, some Type VI systems (e.g., C2C2) appear to possess robust single-stranded nonspecific nuclease (ribonuclease) activity activated by the first crRNA directed cleavage of a target RNA.

Because of their simpler architecture, Class II CRISPR-Cas have been most widely adopted for engineering and development as designer nuclease/genome editing applications.

One of the early adaptations of such a system for in vitro use can be found in Jinek et al. (Science. 2012 Aug. 17; 337(6096):816-21, which is entirely incorporated herein by reference). The Jinek study first described a system that involved (i) recombinantly-expressed, purified full-length Cas9 (e.g., a Class II, Type II Cas enzyme) isolated from *S. pyogenes* SF370, (ii) purified mature ~42 nt crRNA bearing a ~20 nt 5' sequence complementary to the target DNA sequence desired to be cleaved followed by a 3' tracr-binding sequence (the whole crRNA being in vitro transcribed from a synthetic DNA template carrying a T7 promoter sequence); (iii) purified tracrRNA in vitro transcribed from a synthetic DNA template carrying a T7 promoter sequence, and (iv) Mg2+. Jinek later described an improved, engineered system wherein the crRNA of (ii) is joined to the 5' end of (iii) by a linker (e.g., GAAA) to form a single fused synthetic guide RNA (sgRNA) capable of directing Cas9 to a target by itself.

Mali et al. (Science. 2013 Feb. 15; 339(6121): 823-826.), which is entirely incorporated herein by reference, later adapted this system for use in mammalian cells by providing DNA vectors encoding (i) an ORF encoding codon-optimized Cas9 (e.g., a Class II, Type II Cas enzyme) under a suitable mammalian promoter with a C-terminal nuclear localization sequence (e.g., SV40 NLS) and a suitable polyadenylation signal (e.g., TK pA signal); and (ii) an ORF encoding an sgRNA (having a 5' sequence beginning with G followed by 20 nt of a complementary targeting nucleic acid sequence joined to a 3' tracr-binding sequence, a linker, and the tracrRNA sequence) under a suitable Polymerase III promoter (e.g., the U6 promoter).

MG Enzymes

In one aspect, the present disclosure provides for an engineered nuclease system discovered through metagenomic sequencing. In some cases, the metagenomic sequencing is conducted on samples. In some cases, the samples may be collected by a variety of environments. Such environments may be a human microbiome, an animal microbiome, environments with high temperatures, environments with low temperatures. Such environments may include sediment.

MG3 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2242-2251. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2242-2251. In some cases, the endonuclease may comprise a RuvC_III domain, wherein the substantially identical to any one of SEQ ID NOs: 2242-2251. The endonuclease may comprise a RuvC_III domain having at least about 70% sequence identity to any one of SEQ ID NOs: 2242-2244. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2242-2244. In some cases, the endonuclease may comprise a RuvC_III domain substantially identical to any one of SEQ ID NOs: 2242-2244.

The endonuclease may comprise an HNH domain having at least about 70% identity to any one of SEQ ID NOs: 4056-4066. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4056-4066. The endonuclease may comprise an HNH domain substantially identical to any one of SEQ ID NOs: 4056-4066. The endonuclease may comprise an HNH domain having at least about 70% identity to any one of SEQ ID NOs: 4056-4058. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4056-4058. The endonuclease may comprise an HNH domain substantially identical to any one of SEQ ID NOs: 4056-4058.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 421-431. In some cases, the endonuclease may be substantially identical to any one of SEQ ID NOs: 421-431. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:421-423. In some cases, the endonuclease may be substantially identical to any one of SEQ ID NOs: 421-423.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 421-431, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 421-431. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608.

In some cases, sequence identity may be determined by the BLASTP, CLUSTALW, MUSCLE, MAFFT, Novafold, or CLUSTALW with the parameters of the Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5495-5502. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5495-5502. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5495-5502. The tracrRNA may comprise any of SEQ ID NOs: 5495-5502.

In some cases, the at least one engineered synthetic guide ribonucleic acid (sgRNA) capable of forming a complex with the endonuclease may comprise a sequence having at least about 80% identity to any one of SEQ ID NOs: 5466-5467. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5466-5467. The sgRNA may comprise a sequence substantially identical to any one of SEQ ID NOs: 5466-5467.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2242-2251. The deoxyribonucleic acid (DNA) containing an open reading frame encoding said endonuclease may comprise a sequence substantially identical to any of SEQ ID NOs: 5578-5580 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5578-5580. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

Systems of the present disclosure may be used for various applications, such as, for example, nucleic acid editing (e.g., gene editing), binding to a nucleic acid molecule (e.g., sequence-specific binding). Such systems may be used, for example, for addressing (e.g., removing or replacing) a genetically inherited mutation that may cause a disease in a subject, inactivating a gene in order to ascertain its function in a cell, as a diagnostic tool to detect disease-causing genetic elements (e.g. via cleavage of reverse-transcribed viral RNA or an amplified DNA sequence encoding a disease-causing mutation), as deactivated enzymes in combination with a probe to target and detect a specific nucleotide sequence (e.g. sequence encoding antibiotic resistance int bacteria), to render viruses inactive or incapable of infecting host cells by targeting viral genomes, to add genes or amend metabolic pathways to engineer organisms to produce valuable small molecules, macromolecules, or secondary metabolites, to establish a gene drive element for evolutionary selection, to detect cell perturbations by foreign small molecules and nucleotides as a biosensor.

EXAMPLES

Example 1—Metagenomic Analysis for New Proteins

Metagenomic samples were collected from sediment, soil and animal. Deoxyribonucleic acid (DNA) was extracted with a Zymobiomics DNA mini-prep kit and sequenced on an Illumina HiSeq® 2500. Samples were collected with consent of property owners. Additional raw sequence data from public sources included animal microbiomes, sediment, soil, hot springs, hydrothermal vents, marine, peat bogs, permafrost, and sewage sequences. Metagenomic sequence data was searched using Hidden Markov Models generated based on documented Cas protein sequences including type II Cas effector proteins to identify new Cas effectors. Novel effector proteins identified by the search were aligned to documented proteins to identify potential active sites. This metagenomic workflow resulted in delineation of the families of class II, type II CRISPR endonucleases described herein.

Example 2—(General Protocol) PAM Sequence Identification/Confirmation for the Endonucleases Described Herein PAM sequences were determined by sequencing plasmids containing randomly-generated PAM sequences that can be cleaved by putative endonucleases expressed in an *E. coli* lysate-based expression system (myTXTL, Arbor Biosciences). In this system, an *E. coli* codon optimized nucleotide sequence was transcribed and translated from a PCR fragment under control of a T7 promoter. A second PCR fragment with a tracr sequence under a T7 promoter and a minimal CRISPR array composed of a T7 promoter followed by a repeat-spacer-repeat sequence was transcribed in the same reaction. Successful expression of the endonuclease and tracr sequence in the TXTL system followed by CRISPR array processing provided active in vitro CRISPR nuclease complexes.

A library of target plasmids containing a spacer sequence matching that in the minimal array followed by 8N mixed bases (putative PAM sequences) was incubated with the output of the TXTL reaction. After 1-3 hr, the reaction was stopped and the DNA was recovered via a DNA clean-up kit, e.g., Zymo DCC, AMPure XP beads, QiaQuick etc. Adapter sequences were blunt-end ligated to DNA with active PAM sequences that had been cleaved by the endonuclease, whereas DNA that had not been cleaved was inaccessible for ligation. DNA segments comprising active PAM sequences were then amplified by PCR with primers specific to the library and the adapter sequence. The PCR amplification products were resolved on a gel to identify amplicons that corresponded to cleavage events. The amplified segments of the cleavage reaction were also used as template for preparation of an NGS library. Sequencing this resulting library, which was a subset of the starting 8N library, revealed the sequences which contain the correct PAM for the active CRISPR complex. For PAM testing with a single RNA construct, the same procedure was repeated except that an in vitro transcribed RNA was added along with the plasmid library and the tracr/minimal CRISPR array template was omitted. For endonucleases where NGS libraries were prepared, seqLogo (see e.g., Huber et al. Nat Methods. 2015 February; 12(2):115-21) representations were constructed. The seqLogo module used to construct these representations takes the position weight matrix of a DNA sequence motif (e.g. a PAM sequence) and plots the corresponding sequence logo as introduced by Schneider and Stephens (see e.g. Schneider et al. Nucleic Acids Res. 1990 Oct. 25; 18(20): 6097-100. The characters representing the sequence in the seqLogo representations have been stacked on top of each other for each position in the aligned sequences (e.g. PAM sequences). The height of each letter is proportional to its frequency, and the letters have been sorted so the most common one is on top.

Example 3—(General Protocol) RNA Folding of tracrRNA and sgRNA Structures

Folded structures of guide RNA sequences at 37° C. were computed using the method of Andronescu et al. Bioinformatics. 2007 Jul. 1; 23(13):i19-28, which is incorporated by reference herein in its entirety.

Example 4—(General Protocol) In Vitro Cleavage Efficiency of MG CRISPR Complexes Endonucleases were expressed as His-tagged fusion proteins from an inducible T7 promoter in a protease deficient *E. coli* B strain. Cells expressing the His-tagged proteins were lysed by sonication and the His-tagged proteins were purified by Ni-NTA affinity chromatography on a HisTrap FF column (GE Lifescience) on an AKTA Avant FPLC (GE Lifescience). The eluate was resolved by SDS-PAGE on acrylamide gels (Bio-Rad) and stained with InstantBlue Ultrafast coomassie (Sigma-Aldrich). Purity was determined using densitometry of the protein band with ImageLab software (Bio-Rad). Purified endonucleases were dialyzed into a storage buffer composed of 50 mM Tris-HCl, 300 mM NaCl, 1 mM TCEP, 5% glycerol; pH 7.5 and stored at −80° C.

Target DNAs containing spacer sequences and PAM sequences (determined e.g., as in Example 2) were constructed by DNA synthesis. A single representative PAM was chosen for testing when the PAM had degenerate bases. The target DNAs comprised 2200 bp of linear DNA derived from a plasmid via PCR amplification with a PAM and spacer located 700 bp from one end. Successful cleavage resulted in fragments of 700 and 1500 bp. The target DNA, in vitro transcribed single RNA, and purified recombinant protein were combined in cleavage buffer (10 mM Tris, 100 mM NaCl, 10 mM $MgCl_2$) with an excess of protein and RNA and incubated for 5 minutes to 3 hours, usually 1 hr. The reaction was stopped via addition of RNAse A and incubation at 60 minutes. The reaction was then resolved on a 1.2% TAE agarose gel and the fraction of cleaved target DNA is quantified in ImageLab software.

Example 5—(General Protocol) Testing of Genome Cleavage Activity of MG CRISPR Complexes in *E. coli*

*E. coli* lacks the capacity to efficiently repair double-stranded DNA breaks. Thus, cleavage of genomic DNA can be a lethal event. Exploiting this phenomenon, endonuclease activity was tested in *E. coli* by recombinantly expressing an endonuclease and a tracrRNA in a target strain with spacer/target and PAM sequences integrated into its genomic DNA.

In this assay, the PAM sequence is specific for the endonuclease being tested as determined by the methods described in Example 2. sgRNA sequences were determined based upon the sequence and predicted structure of the tracrRNA. Repeat-anti-repeat pairings of 8-12 bp (generally 10 bp) were chosen, starting from the 5' end of the repeat. The remaining 3' end of the repeat and 5' end of the tracrRNA were replaced with a tetraloop. Generally, the tetraloop was GAAA, but other tetraloops can be used, particularly if the GAAA sequence is predicted to interfere with folding. In these cases, a TTCG tetraloop was used.

Engineered strains with PAM sequences integrated into their genomic DNA were transformed with DNA encoding the endonuclease. Transformants were then made chemocompetent and transformed with 50 ng of single guide RNAs either specific to the target sequence (“on target”), or non-specific to the target (“non target”). After heat shock, transformations were recovered in SOC for 2 hrs at 37° C. Nuclease efficiency was then determined by a 5-fold dilution series grown on induction media. Colonies were quantified from the dilution series in triplicate.

Example 6a—(General Protocol) Testing of Genome Cleavage Activity of MG CRISPR Complexes in Mammalian Cells To show targeting and cleavage activity in mammalian cells, the MG Cas effector protein sequences were tested in two mammalian expression vectors: (a) one with a C-terminal SV40 NLS and a 2A-GFP tag, and (b) one with no GFP tag and two SV40 NLS sequences, one on the N-terminus and one on the C-terminus. In some instances, nucleotide sequences encoding the endonucleases were codon-optimized for expression in mammalian cells.

The corresponding single guide RNA sequence (sgRNA) with targeting sequence attached is cloned into a second mammalian expression vector. The two plasmids are cotransfected into HEK293T cells. 72 hr after co-transfection of the expression plasmid and a sgRNA targeting plasmid into HEK293T cells, the DNA is extracted and used for the preparation of an NGS-library. Percent NHEJ is measured via indels in the sequencing of the target site to demonstrate the targeting efficiency of the enzyme in mammalian cells. At least 10 different target sites were chosen to test each protein's activity.

Example 6b—(General Protocol) Testing of Genome Cleavage Activity of MG CRISPR Complexes in Mammalian Cells To show targeting and cleavage activity in mammalian cells, the MG Cas effector protein sequences were cloned into two mammalian expression vector: (a) one with flanking N and C-terminal SV40 NLS sequences, a C-terminal His tag, and a 2A-GFP tag at the C terminus after the His tag (Backbone 1), and (b) one with flanking NLS sequences and C-terminal His tag but no T2A GFP tag (Backbone 2). In some instances, nucleotide sequences encoding the endonucleases were the native sequence, codon-optimized for expression in *E. coli*, or codon-optimized for expression in mammalian cells.

The corresponding single guide RNA sequence (sgRNA) with targeting sequence attached was cloned into a second mammalian expression vector. The two plasmids were cotransfected into HEK293T cells. 72 hr after co-transfection of the expression plasmid and a sgRNA targeting plasmid into HEK293T cells, the DNA was extracted and used for the preparation of an NGS-library. Percent NHEJ was measured via indels in the sequencing of the target site to demonstrate the targeting efficiency of the enzyme in mammalian cells. About 7-12 different target sites were chosen for testing each protein's activity. An arbitrary threshold of 5% indels was used to identify active candidates.

Example 7—Gene Editing Outcomes at the DNA Level for B2M

Primary T cells were purified from PBMCs using a negative selection kit (Miltenyi) according to the manufacturer's recommendations. Nucleofection of MG3-6 RNPs (106 pmol protein/160 pmol guide) (SEQ ID NOs: 6305-6386) was performed into T cells (200,000) using the Lonza 4D electroporator. Cells were harvested and genomic DNA prepared five days post-transfection. PCR primers appropriate for use in NGS-based DNA sequencing were generated, optimized, and used to amplify the individual target sequences for each guide RNA (SEQ ID NOs: 6387-6468). The amplicons were sequenced on an Illumina MiSeq machine and analyzed with a proprietary Python script to measure gene editing (FIG. 1).

TABLE 1A

Guide sequences used in Example 7

| SEQ ID NO: | Entity Name | Sequence |
|---|---|---|
| 6305 | MG3-6-B2M-sgRNA-A1 | mC*mG*mC*rUrArCrUrCrUrCrUrCrUrUrUrCrUrGrGrCrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6306 | MG3-6-B2M-sgRNA-B1 | mA*mG*mA*rGrArCrUrCrArCrGrCrUrGrGrArUrArGrCrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6307 | MG3-6-B2M-sgRNA-C1 | mG*mA*mG*rArGrArGrUrArGrCrGrCrGrArGrCrArCrArGrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6308 | MG3-6-B2M-sgRNA-D1 | mC*mC*mC*rGrArUrArUrUrCrCrUrCrArGrGrUrArCrUrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6309 | MG3-6-B2M-sgRNA-E1 | mA*mU*mU*rCrCrUrCrArGrGrUrArCrUrCrCrArArArGrArUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |

TABLE 1A-continued

Guide sequences used in Example 7

| SEQ ID NO: | Entity Name | Sequence |
|---|---|---|
| 6310 | MG3-6-B2M-sgRNA-F1 | mA*mA*mU*rUrUrCrCrUrGrArArUrUrGrCrUrArUrGrUrGrUr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6311 | MG3-6-B2M-sgRNA-G1 | mG*mA*mG*rArArUrUrGrArArArArArGrUrGrGrArGrCrArUr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6312 | MG3-6-B2M-sgRNA-H1 | mG*mC*mA*rUrUrCrArGrArCrUrUrGrUrCrUrUrUrCrArGrCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6313 | MG3-6-B2M-sgRNA-A2 | mA*mG*mA*rCrUrUrArCrCrCrCrArCrUrUrArArCrUrArUrCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6314 | MG3-6-B2M-sgRNA-B2 | mU*mU*mC*rArGrUrGrUrArGrUrArCrArArGrArGrArUrArGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6315 | MG3-6-B2M-sgRNA-C2 | mA*mG*mU*rUrCrUrCrCrUrUrGrGrUrGrGrCrCrCrGrCrCrGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6316 | MG3-6-B2M-sgRNA-D2 | mG*mU*mG*rGrCrCrCrGrCrCrGrUrGrGrGrGrCrUrArGrUrCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6317 | MG3-6-B2M-sgRNA-E2 | mC*mC*mG*rCrCrGrUrGrGrGrGrCrUrArGrUrCrCrArGrGrGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrUxmU*mU*mU |
| 6318 | MG3-6-B2M-sgRNA-F2 | mG*mC*mC*rCrCrUrUrUrCrGrGrCrGrGrGrGrArGrCrArGrGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6319 | MG3-6-B2M-sgRNA-G2 | mG*mA*mC*rCrUrUrUrGrGrCrCrUrArCrGrGrCrGrArCrGrGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6320 | MG3-6-B2M-sgRNA-H2 | mG*mC*mG*rUrCrGrArUrArArGrCrGrUrCrArGrArGrCrGrCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6321 | MG3-6-B2M-sgRNA-A3 | mC*mG*mU*rCrArGrArGrCrGrCrCrGrArGrGrUrUrGrGrGrGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |

TABLE 1A-continued

Guide sequences used in Example 7

| SEQ ID NO: | Entity Name | Sequence |
|---|---|---|
| 6322 | MG3-6-B2M-sgRNA-B3 | mG*mG*mG*rUrUrUrCrUrCrUrUrCrCrGrCrUrCrUrUrUrCrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6323 | MG3-6-B2M-sgRNA-C3 | mG*mC*mG*rCrArGrCrUrGrGrArGrUrGrGrGrGrArCrGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6324 | MG3-6-B2M-sgRNA-D3 | mG*mC*mU*rCrGrUrCrCrCrArArArGrGrCrGrCrGrGrCrGrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6325 | MG3-6-B2M-sgRNA-E3 | mU*mG*mU*rGrArArCrGrCrGrUrGrGrArGrGrGrGrCrGrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6326 | MG3-6-B2M-sgRNA-F3 | mG*mU*mC*rUrGrCrUrGrCrGrGrCrUrCrUrGrCrUrUrCrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6327 | MG3-6-B2M-sgRNA-G3 | mG*mC*mU*rUrCrCrCrUrUrArGrArCrUrGrGrArGrArGrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6328 | MG3-6-B2M-sgRNA-H3 | mA*mA*mG*rUrUrCrGrCrArUrGrUrCrCrUrArGrCrArCrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6329 | MG3-6-B2M-sgRNA-A4 | mU*mC*mC*rUrArGrCrArCrCrUrCrUrGrGrGrUrCrUrArUrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6330 | MG3-6-B2M-sgRNA-B4 | mC*mC*mU*rCrCrCrCrArCrGrGrUrGrUrGrGrCrCrCrCrArCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6331 | MG3-6-B2M-sgRNA-C4 | mA*mA*mG*rGrGrArArGrCrArGrArGrCrCrGrCrArGrCrArGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrUxmU*mU*mU |
| 6332 | MG3-6-B2M-sgRNA-D4 | mG*mC*mU*rUrArCrCrCrGrGrGrCrGrArCrGrCrCrUrCrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrUmU*mU*mU |
| 6333 | MG3-6-B2M-sgRNA-E4 | mC*mU*mC*rCrArGrCrUrGrCrGrCrUrGrGrGrGrArGrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |

TABLE 1A-continued

Guide sequences used in Example 7

| SEQ ID NO: | Entity Name | Sequence |
|---|---|---|
| 6334 | MG3-6-B2M-sgRNA-F4 | mU*mU*mG*rUrCrCrCrGrArCrCrCrUrCrCrCrGrUrCrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6335 | MG3-6-B2M-sgRNA-G4 | mG*mA*mC*rCrCrUrCrCrCrGrUrCrGrCrCrGrUrArGrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6336 | MG3-6-B2M-sgRNA-H4 | mG*mU*mG*rCrGrCrArCrCrCrCrCrUrUrCrCrCrCrArCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6337 | MG3-6-B2M-sgRNA-A5 | mC*mC*mA*rGrGrCrCrArCrCrCrCrGrCrCrGrCrUrUrCrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6338 | MG3-6-B2M-sgRNA-B5 | mG*mC*mC*rGrCrUrUrCrCrCrCrGrArGrArUrCrCrArGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6339 | MG3-6-B2M-sgRNA-C5 | mC*mC*mA*rGrCrCrCrUrGrGrArCrUrArGrCrCrCrCrArCrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6340 | MG3-6-B2M-sgRNA-D5 | mU*mC*mA*rCrGrGrArGrCrGrArGrArGrArGrCrArCrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6341 | MG3-6-B2M-sgRNA-E5 | mA*mG*mA*rGrGrGrUrGrCrArGrArGrCrGrGrGrArGrArGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6342 | MG3-6-B2M-sgRNA-F5 | mA*mG*mG*rArCrCrArGrArGrCrGrGrGrArGrGrGrUrArGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6343 | MG3-6-B2M-sgRNA-G5 | mC*mG*mA*rGrArUrUrGrArArGrUrCrArArGrCrCrUrArArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6344 | MG3-6-B2M-sgRNA-H5 | mA*mG*mA*rArArArArCrGrCrCrUrGrCrCrUrUrCrUrGrCrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6345 | MG3-6-B2M-sgRNA-A6 | mU*mC*mU*rCrCrArGrArGrCrArArArCrUrGrGrGrCrGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

TABLE 1A-continued

Guide sequences used in Example 7

| SEQ ID NO: | Entity Name | Sequence |
|---|---|---|
| 6346 | MG3-6-B2M-sgRNA-B6 | mG*mG*mC*rCrCrUrGrUrGrGrUrCrUrUrUrUrCrGrUrArCrAr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6347 | MG3-6-B2M-sgRNA-C6 | mA*mC*mU*rUrUrCrGrGrUrUrUrUrGrArArArArCrArUrGrAr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6348 | MG3-6-B2M-sgRNA-D6 | mA*mA*mA*rGrArGrGrArArGrCrCrCrUrCrUrGrUrArCrGrAr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6349 | MG3-6-B2M-sgRNA-E6 | mA*mG*mC*rCrCrUrCrUrGrUrArCrGrArArArArGrArCrCrAr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6350 | MG3-6-B2M-sgRNA-F6 | mU*mG*mC*rGrCrUrCrCrCrGrCrArArArArGrCrCrCrUrGrGr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6351 | MG3-6-B2M-sgRNA-G6 | mA*mA*mA*rArGrArArArArGrArArArGrArArArGrArArGrUr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6352 | MG3-6-B2M-sgRNA-H6 | mA*mA*mA*rGrArUrArArUrCrCrArArGrArUrGrGrUrUrArCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6353 | MG3-6-B2M-sgRNA-A7 | mU*mA*mC*rCrArArGrArCrUrGrUrUrGrArGrGrArCrGrCrCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6354 | MG3-6-B2M-sgRNA-B7 | mU*mC*mC*rArArArGrUrArArUrArCrArUrGrCrCrArUrGrCr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrUmU*mU*mU |
| 6355 | MG3-6-B2M-sgRNA-C7 | mA*mU*mU*rArCrUrUrUrGrGrArArArUrUrUrUrCrArArArAr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6356 | MG3-6-B2M-sgRNA-D7 | mA*mA*mA*rUrArArGrArUrUrUrUrUrUrUrUrArArArUrAr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |
| 6357 | MG3-6-B2M-sgRNA-E7 | mU*mG*mC*rCrArGrGrUrArCrUrUrArGrArArArGrUrGrCrUr<br>GrUrUrGrArGrArArUrCrGrArArArGrArUrUrCrUrUrArArUrAr<br>ArGrGrCrArUrCrCrUrUrCrCrGrArUrGrCrUrGrArCrUrUrCrUr<br>CrArCrCrGrUrCrCrGrUrUrUrUrCrCrArArUrArGrGrArGrCrGr<br>GrGrCrGrGrUrArUrGrU*mU*mU*mU |

TABLE 1A-continued

Guide sequences used in Example 7

| SEQ ID NO: | Entity Name | Sequence |
|---|---|---|
| 6358 | MG3-6-B2M-sgRNA-F7 | mC*mU*mC*rArArCrArGrUrCrUrUrGrGrUrArArCrCrArUrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6359 | MG3-6-B2M-sgRNA-G7 | mU*mG*mA*rUrArCrUrUrGrUrCrCrUrCrUrUrCrUrUrArGrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6360 | MG3-6-B2M-sgRNA-H7 | mG*mC*mU*rUrUrUrArArUrGrUrUrArUrGrArArArArArArAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6361 | MG3-6-B2M-sgRNA-A8 | mU*mA*mU*rGrArArArArArArArUrCrArGrGrUrCrUrUrCrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6362 | MG3-6-B2M-sgRNA-B8 | mG*mA*mU*rUrCrCrCrCrArArUrCrCrArCrCrUrCrUrUrGrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6363 | MG3-6-B2M-sgRNA-C8 | mG*mG*mC*rArGrCrUrArCrUrCrCrUrCrCrUrUrGrUrCrUrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrUxmU*mU*mU |
| 6364 | MG3-6-B2M-sgRNA-D8 | mG*mC*mU*rGrUrGrGrGrGrArGrArArGrGrArGrGrArGrUrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6365 | MG3-6-B2M-sgRNA-E8 | mU*mA*mG*rArArArCrArCrCrCrUrArUrCrArUrUrArArGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrUxmU*mU*mU |
| 6366 | MG3-6-B2M-sgRNA-F8 | mA*mG*mG*rCrUrArCrUrArGrCrCrCrCrArUrCrArArGrArGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6367 | MG3-6-B2M-sgRNA-G8 | mG*mA*mG*rGrUrGrGrArUrUrGrGrGrGrArArUrCrUrArArUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6368 | MG3-6-B2M-sgRNA-H8 | mA*mU*mA*rArGrArArCrArUrArUrUrArArArUrGrCrCrUrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 6369 | MG3-6-B2M-sgRNA-A9 | mU*mA*mA*rArUrGrCrCrUrCrArGrGrGrArUrCrArGrArGrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrUxmU*mU*mU |

TABLE 1A-continued

Guide sequences used in Example 7

| SEQ ID NO: | Entity Name | Sequence |
|---|---|---|
| 6370 | MG3-6-B2M-sgRNA-B9 | mC*mU*mC*rUrCrUrGrUrUrGrArGrGrArArGrGrCrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrUxmU*mU*mU |
| 6371 | MG3-6-B2M-sgRNA-C9 | mC*mU*mA*rArGrArArGrArGrGrArCrArArGrUrArUrCrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6372 | MG3-6-B2M-sgRNA-D9 | mC*mA*mC*rCrUrArUrCrCrCrUrGrUrUrGrUrArUrUrUrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6373 | MG3-6-B2M-sgRNA-E9 | mA*mU*mU*rUrGrCrCrArGrCrUrCrUrGrUrArUrGrCrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6374 | MG3-6-B2M-sgRNA-F9 | mG*mA*mA*rArUrUrArGrGrUrArCrArArArGrUrCrArGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6375 | MG3-6-B2M-sgRNA-G9 | mU*mA*mU*rArArArArCrCrUrCrArGrCrArGrArArArUrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6376 | MG3-6-B2M-sgRNA-H9 | mU*mG*mU*rUrGrUrUrUrGrGrUrArArGrArArCrArUrArCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6377 | MG3-6-B2M-sgRNA-A10 | mA*mA*mC*rArArArArCrCrUrCrUrUrUrArUrUrUrCrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6378 | MG3-6-B2M-sgRNA-B10 | mA*mU*mU*rUrCrUrGrCrUrGrArGrGrUrUrUrUrArUrArUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6379 | MG3-6-B2M-sgRNA-C10 | mG*mC*mA*rArArUrArCrCrUrUrArArArUrGrGrUrUrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6380 | MG3-6-B2M-sgRNA-D10 | mA*mU*mA*rArArArUrArCrArArCrArGrGrGrArUrArGrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6381 | MG3-6-B2M-sgRNA-E10 | mA*mA*mU*rGrGrArGrUrArArUrGrCrArUrGrUrGrArCrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6382 | MG3-6-B2M-sgRNA-F10 | mA*mC*mA*rGrGrUrGrArUrUrGrCrUrGrUrArArArCrUrArGrGrUrUrGrArGrArArUrCrGrArArArGrArUrUrCrUrUrArArUrAr |

TABLE 1A-continued

| Guide sequences used in Example 7 | | |
|---|---|---|
| SEQ ID NO: | Entity Name | Sequence |
| | | ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 6383 | MG3-6-B2M-sgRNA-G10 | mC*mU*mU*rUrCrCrArArArArUrGrArGrArGrGrCrArUrGrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 6384 | MG3-6-B2M-sgRNA-H10 | mA*mA*mU*rArUrUrGrCrCrArGrGrGrUrArUrUrUrCrArCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 6385 | MG3-6-B2M-sgRNA-A11 | mU*mG*mC*rCrUrUrUrUrUrGrUrUrUrUrUrUrUrCrUrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 6386 | MG3-6-B2M-sgRNA-B11 | mU*mC*mU*rArGrCrArGrUrArUrCrUrUrCrUrGrUrCrArCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |

Notations for chemical modifications: m = 2'O-methyl ribonucleotide (e.g mC = cytosine ribonucleotide with 2'-O Methyl in place of 2' hydroxyl); f = 2'-fluoro ribonucleotide (e.g fC = cytosine ribonucleotide with 2' fluorine in place of 2' hydroxyl); * = phosphorothioate bond; r: native RNA linkage comprising the sugar ribose (for example the ribose or RNA form of the A base is written rA), d: deoxyribose sugar (DNA) linkage (for example a deoxyribose form of the A base is written dA)

TABLE 1B

| Sites targeted in Example 7 | | |
|---|---|---|
| SEQ ID NO: | Entity Name | Sequence |
| 6387 | MG3-6-B2M-target site-A1 | CGCTACTCTCT CTTTCTGGCCT |
| 6388 | MG3-6-B2M-target site-B1 | AGAGACTCACG CTGGATAGCCT |
| 6389 | MG3-6-B2M-target site-C1 | GAGAGAGTAGC GCGAGCACAGC |
| 6390 | MG3-6-B2M-target site-D1 | CCCGATATTCC TCAGGTACTCC |
| 6391 | MG3-6-B2M-target site-E1 | ATTCCTCAGGT ACTCCAAAGAT |
| 6392 | MG3-6-B2M-target site-F1 | AATTTCCTGAA TTGCTATGTGT |
| 6393 | MG3-6-B2M-target site-G1 | GAGAATTGAAA AAGTGGAGCAT |
| 6394 | MG3-6-B2M-target site-H1 | GCATTCAGACT TGTCTTTCAGC |
| 6395 | MG3-6-B2M-target site-A2 | AGACTTACCCC ACTTAACTATC |
| 6396 | MG3-6-B2M-target site-B2 | TTCAGTGTAGT ACAAGAGATAG |
| 6397 | MG3-6-B2M-target site-C2 | AGTTCTCCTTG GTGGCCCGCCG |

TABLE 1B-continued

| Sites targeted in Example 7 | | |
|---|---|---|
| SEQ ID NO: | Entity Name | Sequence |
| 6398 | MG3-6-B2M-target site-D2 | GTGGCCCGCCG TGGGGCTAGTC |
| 6399 | MG3-6-B2M-target site-E2 | CCGCCGTGGGG CTAGTCCAGGG |
| 6400 | MG3-6-B2M-target site-F2 | GCCCCTTTCGG CGGGGAGCAGG |
| 6401 | MG3-6-B2M-target site-G2 | GACCTTTGGCC TACGGCGACGG |
| 6402 | MG3-6-B2M-target site-H2 | GCGTCGATAAG CGTCAGAGCGC |
| 6403 | MG3-6-B2M-target site-A3 | CGTCAGAGCGC CGAGGTTGGGG |
| 6404 | MG3-6-B2M-target site-B3 | GGGTTTCTCTT CCGCTCTTTCG |
| 6405 | MG3-6-B2M-target site-C3 | GCGCAGCTGGA GTGGGGGACGG |
| 6406 | MG3-6-B2M-target site-D3 | GCTCGTCCCAA AGGCGCGGCGC |
| 6407 | MG3-6-B2M-target site-E3 | TGTGAACGCGT GGAGGGGCGCT |

TABLE 1B-continued

Sites targeted in Example 7

| SEQ ID NO: | Entity Name | Sequence |
|---|---|---|
| 6408 | MG3-6-B2M-target site-F3 | GTCTGCTGCGG CTCTGCTTCCC |
| 6409 | MG3-6-B2M-target site-G3 | GCTTCCCTTAG ACTGGAGAGCT |
| 6410 | MG3-6-B2M-target site-H3 | AAGTTCGCATG TCCTAGCACCT |
| 6411 | MG3-6-B2M-target site-A4 | TCCTAGCACCT CTGGGTCTATG |
| 6412 | MG3-6-B2M-target site-B4 | CCTCCCCACGG TGTGGCCCCAC |
| 6413 | MG3-6-B2M-target site-C4 | AAGGGAAGCAG AGCCGCAGCAG |
| 6414 | MG3-6-B2M-target site-D4 | GCTTACCCGGG CGACGCCTCCC |
| 6415 | MG3-6-B2M-target site-E4 | CTCCAGCTGCG CTGGGGGAGCC |
| 6416 | MG3-6-B2M-target site-F4 | TTGTCCCGACC CTCCCGTCGCC |
| 6417 | MG3-6-B2M-target site-G4 | GACCCTCCCGT CGCCGTAGGCC |
| 6418 | MG3-6-B2M-target site-H4 | GTGCGCACCCC CTTCCCCACTC |
| 6419 | MG3-6-B2M-target site-A5 | CCAGGCCACCC CGCCGCTTCCC |
| 6420 | MG3-6-B2M-target site-B5 | GCCGCTTCCCC GAGATCCAGCC |
| 6421 | MG3-6-B2M-target site-C5 | CCAGCCCTGGA CTAGCCCCACG |
| 6422 | MG3-6-B2M-target site-D5 | TCACGGAGCGA GAGAGCACAGC |
| 6423 | MG3-6-B2M-target site-E5 | AGAGGGTGCAG AGCGGGAGAGG |
| 6424 | MG3-6-B2M-target site-F5 | AGGACCAGAGC GGGAGGGTAGG |
| 6425 | MG3-6-B2M-target site-G5 | CGAGATTGAAG TCAAGCCTAAC |
| 6426 | MG3-6-B2M-target site-H5 | AGAAAAACGCC TGCCTTCTGCG |
| 6427 | MG3-6-B2M-target site-A6 | TCTCCAGAGCA AACTGGGCGGC |
| 6428 | MG3-6-B2M-target site-B6 | GGCCCTGTGGT CTTTTCGTACA |
| 6429 | MG3-6-B2M-target site-C6 | ACTTTCGGTTT TGAAAACATGA |
| 6430 | MG3-6-B2M-target site-D6 | AAAGAGGAAGC CCTCTGTACGA |
| 6431 | MG3-6-B2M-target site-E6 | AGCCCTCTGTA CGAAAAGACCA |
| 6432 | MG3-6-B2M-target site-F6 | TGCGCTCCCGC AAAAGCCCTGG |

TABLE 1B-continued

Sites targeted in Example 7

| SEQ ID NO: | Entity Name | Sequence |
|---|---|---|
| 6433 | MG3-6-B2M-target site-G6 | AAAAGAAAAGA AAGAAAGAAGT |
| 6434 | MG3-6-B2M-target site-H6 | AAAGATAATCC AAGATGGTTAC |
| 6435 | MG3-6-B2M-target site-A7 | TACCAAGACTG TTGAGGACGCC |
| 6436 | MG3-6-B2M-target site-B7 | TCCAAAGTAAT ACATGCCATGC |
| 6437 | MG3-6-B2M-target site-C7 | ATTACTTTGGA AATTTTCAAAA |
| 6438 | MG3-6-B2M-target site-D7 | AAATAAGATTT TTTTTTAAATA |
| 6439 | MG3-6-B2M-target site-E7 | TGCCAGGTACT TAGAAAGTGCT |
| 6440 | MG3-6-B2M-target site-F7 | CTCAACAGTCT TGGTAACCATC |
| 6441 | MG3-6-B2M-target site-G7 | TGATACTTGTC CTCTTCTTAGA |
| 6442 | MG3-6-B2M-target site-H7 | GCTTTTAATGT TATGAAAAAAA |
| 6443 | MG3-6-B2M-target site-A8 | TATGAAAAAAA TCAGGTCTTCA |
| 6444 | MG3-6-B2M-target site-B8 | GATTCCCCAAT CCACCTCTTGA |
| 6445 | MG3-6-B2M-target site-C8 | GGCAGCTACTC CTCCTTGTCTG |
| 6446 | MG3-6-B2M-target site-D8 | GCTGTGGGGAG AAGGAGGAGTA |
| 6447 | MG3-6-B2M-target site-E8 | TAGAAACACCC TATCATTAAGG |
| 6448 | MG3-6-B2M-target site-F8 | AGGCTACTAGC CCCATCAAGAG |
| 6449 | MG3-6-B2M-target site-G8 | GAGGTGGATTG GGGAATCTAAT |
| 6450 | MG3-6-B2M-target site-H8 | ATAAGAACATA TTAAATGCCTC |
| 6451 | MG3-6-B2M-target site-A9 | TAAATGCCTCA GGGATCAGAGC |
| 6452 | MG3-6-B2M-target site-B9 | CTCTCTGTTTG AGGGAAGGCGG |
| 6453 | MG3-6-B2M-target site-C9 | CTAAGAAGAGG ACAAGTATCAG |
| 6454 | MG3-6-B2M-target site-D9 | CACCTATCCCT GTTGTATTTTA |
| 6455 | MG3-6-B2M-target site-E9 | ATTTGCCAGCT CTTGTATGCAT |
| 6456 | MG3-6-B2M-target site-F9 | GAAATTAGGTA CAAAGTCAGAG |

TABLE 1B-continued

Sites targeted in Example 7

| SEQ ID NO: | Entity Name | Sequence |
|---|---|---|
| 6457 | MG3-6-B2M-target site-G9 | TATAAAACCTC AGCAGAAATAA |
| 6458 | MG3-6-B2M-target site-H9 | TGTTGTTTGGT AAGAACATACC |
| 6459 | MG3-6-B2M-target site-A10 | AACAAAACCTC TTTATTTCTGC |
| 6460 | MG3-6-B2M-target site-B10 | ATTTCTGCTGA GGTTTTATATG |
| 6461 | MG3-6-B2M-target site-C10 | GCAAATACCTT AAATGGTTGAG |
| 6462 | MG3-6-B2M-target site-D10 | ATAAAATACAA CAGGGATAGGT |
| 6463 | MG3-6-B2M-target site-E10 | AATGGAGTAAT GCATGTGACAG |
| 6464 | MG3-6-B2M-target site-F10 | ACAGGTGATTG CTGTAAACTAG |
| 6465 | MG3-6-B2M-target site-G10 | CTTTCCAAAAT GAGAGGCATGA |
| 6466 | MG3-6-B2M-target site-H10 | AATATTGCCAG GGTATTTCACT |
| 6467 | MG3-6-B2M-target site-A11 | TGCCTTTTTTG TTTTTTTTCTA |
| 6468 | MG3-6-B2M-target site-B11 | TCTAGCAGTAT CTTCTGTCACT |

Example 8—Gene Editing Outcomes at the DNA Level for Mouse TRAC

Figure 2A:
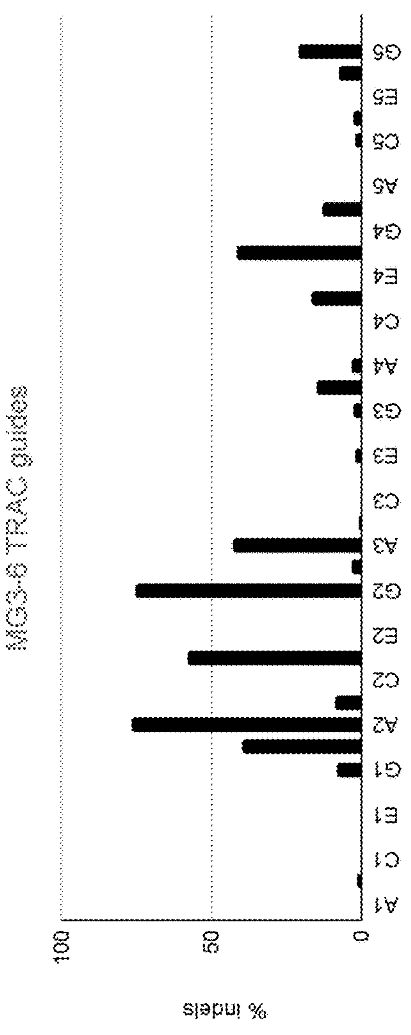
FIG. 2A and FIG. 2B depicts the gene editing outcomes at the DNA level for mouse TRAC.
Figure 2B:
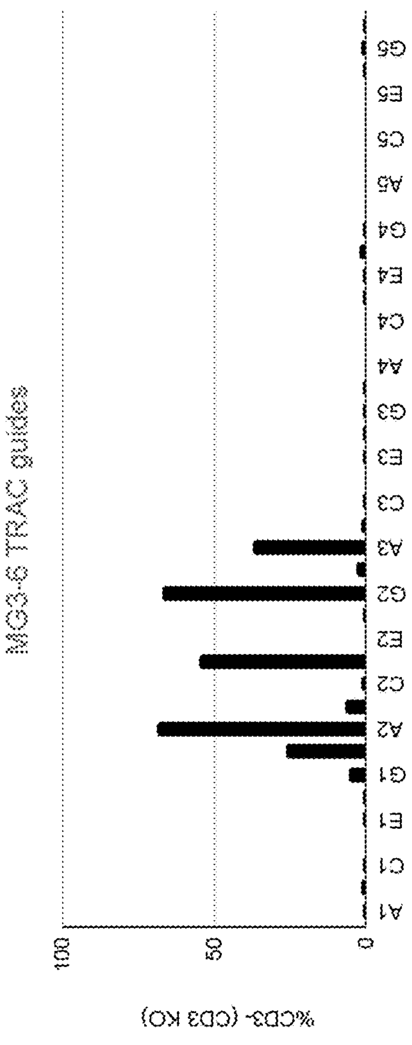

Primary T cells were purified from C57BL/6 mouse spleens. Nucleofection of MG3-6 RNPs (126 pmol protein/160 pmol guide) (SEQ ID NOs: 6469-6508) was performed into T cells (200,000) using the Lonza 4D electroporator and 100 pmol transfection enhancer (IDT). Cells were harvested and genomic DNA prepared five days post-transfection. PCR primers appropriate for use in NGS-based DNA sequencing were generated, optimized, and used to amplify the individual target sequences for each guide RNA (SEQ ID NOs: 6509-6548). The amplicons were sequenced on an Illumina MiSeq machine and analyzed with a proprietary Python script to measure gene editing (FIG. 2). For analysis by flow cytometry, 3 days post-nucleofection, 100,000 mouse T cells were stained with anti-mouse CD3 antibody (Clone 17A2, Invitrogen 11-0032-82) for 30 minutes at 4° C. and analyzed on an Attune Nxt flow cytometer.

TABLE 2A

Guide sequences used in Example 8

| SEQ ID NO: | Entity Name | Sequence |
|---|---|---|
| 6469 | MG3-6-mTRAC-sgRNA-A1 | mA*mG*mA*rArCrCrUrGrCrUrGrUrGrUrArCrCrArGrUrUrArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6470 | MG3-6-mTRAC-sgRNA-B1 | mA*mA*mC*rUrGrUrGrCrUrGrGrArCrArUrGrArArArGrCrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6471 | MG3-6-m TRAC-sgRNA-C1 | mA*mA*mG*rCrUrArUrGrGrArUrUrCrCrArArGrArGrCrArArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6472 | MG3-6-m TRAC-sgRNA-D1 | mUmC*mA*rCrCrUrGrCrCrArArGrArUrArUrCrUrUrCrArArGrU rUrGrArGrArArUrCrGrArArArGrArUrUrCrUrUrArArUrArArGrG rCrArUrCrCrUrUrCrCrGrArUrGrCrUrGrArCrUrUrCrUrCrArCrC rGrUrCrCrGrUrUrUrUrCrCrArArUrArGrGrArGrCrGrGrGrCrGr GrUrArUrGrU*mU*mU*mU |
| 6473 | MG3-6-mTRAC-sgRNA-E1 | mA*mG*mU*rUrUrUrGrUrCrArGrUrGrArUrGrArArCrGrUrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6474 | MG3-6-mTRAC-sgRNA-F1 | mG*mA*mA*rCrArGrGrCrArGrArGrGrGrUrGrCrUrGrUrCrCrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr |

TABLE 2A-continued

| Guide sequences used in Example 8 | | |
|---|---|---|
| SEQ ID NO: | Entity Name | Sequence |
| | | CrGrUrCrCrGrUrUrUrUrCrCrArArUrArGrGrArGrCrGrGrGrCrGr<br>GrUrArUrGrU*mU*mU*mU |
| 6475 | MG3-6-mTRAC-sgRNA-G1 | mC*mA*mG*rArGrGrGrUrGrCrUrGrUrCrCrUrGrArGrArCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6476 | MG3-6-mTRAC-sgRNA-H1 | mA*mG*mG*rArUrCrUrUrUrUrArArCrUrGrGrUrArCrArCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6477 | MG3-6-mTRAC-sgRNA-A2 | mUmU*mU*rArArCrUrGrGrUrArCrArCrArGrCrArGrGrUrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6478 | MG3-6-mTRAC-sgRNA-B2 | mA*mG*mG*rUrUrCrUrGrGrGrUrUrCrUrGrGrArUrGrUrCrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6479 | MG3-6-mTRAC-sgRNA-C2 | mA*mA*mC*rUrUrUrCrArArArArCrCrUrGrUrCrArGrUrUrArGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrU*mU*mU*mU |
| 6480 | MG3-6-mTRAC-sgRNA-D2 | mC*mG*mA*rArUrCrCrUrCrCrUrGrCrUrGrArArArGrUrArGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6481 | MG3-6-mTRAC-sgRNA-E2 | mG*mG*mA*rUrUrUrArArCrCrUrGrCrUrCrArUrGrArCrGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6482 | MG3-6-mTRAC-sgRNA-F2 | mC*mU*mU*rUrCrArUrGrCrCrUrUrCrUrUrArCrCrUrCrArArGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrU*mU*mU*mU |
| 6483 | MG3-6-mTRAC-sgRNA-G2 | mG*mA*mC*rCrArCrArGrCrCrUrCrArGrCrGrUrCrArUrGrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6484 | MG3-6-m TRAC-sgRNA-H2 | mU*mA*mA*rArUrCrCrGrGrCrUrArCrUrUrUrCrArGrCrArGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6485 | MG3-6-mTRAC-sgRNA-A3 | mA*mG*mG*rArUrUrCrGrGrArGrUrCrCrCrArUrArArCrUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6486 | MG3-6-mTRAC-sgRNA-B3 | mA*mU*mA*rArCrUrGrArCrArGrGrUrUrUrUrGrArArArGrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |

TABLE 2A-continued

Guide sequences used in Example 8

| SEQ ID NO: | Entity Name | Sequence |
|---|---|---|
| 6487 | MG3-6-m TRAC-sgRNA-C3 | mG*mU*mA*rCrUrUrCrCrUrCrArCrUrCrCrArGrGrUrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6488 | MG3-6-mTRAC-sgRNA-D3 | mC*mC*mA*rCrCrUrCrGrUrCrArArGrArCrGrGrCrUrGrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6489 | MG3-6-mTRAC-sgRNA-E3 | mU*mG*mG*rCrCrCrUrGrArUrUrCrArCrArArUrCrCrCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6490 | MG3-6-mTRAC-sgRNA-F3 | mU*mU*mC*rArCrArArUrCrCrCrArCrCrUrGrGrArUrCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6491 | MG3-6-mTRAC-sgRNA-G3 | mC*mU*mG*rGrArUrCrUrCrCrCrArGrArUrUrUrGrUrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrUmU*mU*mU |
| 6492 | MG3-6-mTRAC-sgRNA-H3 | mC*mA*mU*rUrCrArCrArArArArArArCrGrGrCrArGrGrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6493 | MG3-6-m TRAC-sgRNA-A4 | mA*mA*mC*rGrGrCrArGrGrGrGrCrGrGrGrGrCrUrUrCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6494 | MG3-6-mTRAC-sgRNA-B4 | mG*mG*mG*rCrGrGrGrGrCrUrUrCrUrCrCrUrGrGrArUrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6495 | MG3-6-mTRAC-sgRNA-C4 | mA*mU*mC*rUrGrArArGrArCrCrCrCrUrCrCrCrCrCrArUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6496 | MG3-6-mTRAC-sgRNA-D4 | mG*mU*mU*rUrUrUrUrGrUrUrUrUrUrUrUrUrUrUrUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6497 | MG3-6-mTRAC-sgRNA-E4 | mG*mG*mU*rGrUrArGrArArArUrUrArUrCrUrCrArUrUrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 6498 | MG3-6-mTRAC-sgRNA-F4 | mG*mG*mC*rUrCrArArUrArCrArCrArCrArGrUrArGrCrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |

TABLE 2A-continued

| Guide sequences used in Example 8 | | |
|---|---|---|
| SEQ ID NO: | Entity Name | Sequence |
| 6499 | MG3-6-mTRAC-sgRNA-G4 | mA*mU*mU*rUrUrUrUrUrUrArCrArArCrArUrUrCrUrCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6500 | MG3-6-m TRAC-sgRNA-H4 | mA*mC*mA*rGrGrGrGrArGrUrCrUrGrCrCrArUrGrGrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6501 | MG3-6-m TRAC-sgRNA-A5 | mG*mU*mC*rUrGrCrCrArUrGrGrGrGrArGrGrGrUrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 6502 | MG3-6-mTRAC-sgRNA-B5 | mA*mG*mC*rArArCrCrUrUrCrCrUrCrArCrArArArUrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6503 | MG3-6-mTRAC-sgRNA-C5 | mU*mC*mA*rCrArArArUrCrUrGrGrGrArGrArUrCrCrArGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6504 | MG3-6-mTRAC-sgRNA-D5 | mA*mG*mA*rUrCrCrArGrGrUrGrGrGrArUrUrGrUrGrArArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6505 | MG3-6-mTRAC-sgRNA-E5 | mU*mG*mG*rGrArUrUrGrUrGrArArUrCrArGrGrGrCrCrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6506 | MG3-6-mTRAC-sgRNA-F5 | mG*mA*mC*rArGrCrCrGrUrCrUrUrGrArCrGrArGrGrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6507 | MG3-6-mTRAC-sgRNA-G5 | mU*mG*mA*rGrGrArGrGrArUrGrGrArGrCrUrUrGrGrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6508 | MG3-6-mTRAC-sgRNA-H5 | mG*mG*mA*rGrUrCrArGrGrCrUrCrUrGrUrCrArGrUrCrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

Notations for chemical modifications: m = 2'O-methyl ribonucleotide (e.g mC = cytosine ribonucleotide with 2'-O Methyl in place of 2' hydroxyl); f = 2'-fluoro ribonucleotide (e.g fC = cytosine ribonucleotide with 2' fluorine in place of 2' hydroxyl); * = phosphorothioate bond; r: native RNA linkage comprising the sugar ribose (for example the ribose or RNA form of the A base is written rA), d: deoxyribose sugar (DNA) linkage (for example a deoxyribose form of the A base is written dA)

TABLE 2B

List of sites targeted in Example 8

| SEQ ID NO: | Entity Name | Sequence |
|---|---|---|
| 6509 | MG3-6-mTRAC-target site-A1 | AGAACCTGCTGTGTACCAGTTA |
| 6510 | MG3-6-mTRAC-target site-B1 | AACTGTGCTGGACATGAAAGCT |
| 6511 | MG3-6-mTRAC-target site-C1 | AAGCTATGGATTCCAAGAGCAA |
| 6512 | MG3-6-mTRAC-target site-D1 | TCACCTGCCAAGATATCTTCAA |
| 6513 | MG3-6-mTRAC-target site-E1 | AGTTTTGTCAGTGATGAACGTT |
| 6514 | MG3-6-mTRAC-target site-F1 | GAACAGGCAGAGGGTGCTGTCC |
| 6515 | MG3-6-mTRAC-target site-G1 | CAGAGGGTGCTGTCCTGAGACC |
| 6516 | MG3-6-mTRAC-target site-H1 | AGGATCTTTTAACTGGTACACA |
| 6517 | MG3-6-mTRAC-target site-A2 | TTTAACTGGTACACAGCAGGTT |
| 6518 | MG3-6-mTRAC-target site-B2 | AGGTTCTGGGTTCTGGATGTCT |
| 6519 | MG3-6-mTRAC-target site-C2 | AACTTTCAAAACCTGTCAGTTA |
| 6520 | MG3-6-mTRAC-target site-D2 | CGAATCCTCCTGCTGAAAGTAG |
| 6521 | MG3-6-mTRAC-target site-E2 | GGATTTAACCTGCTCATGACGC |
| 6522 | MG3-6-mTRAC-target site-F2 | CTTTCATGCCTTCTTACCTCAA |
| 6523 | MG3-6-mTRAC-target site-G2 | GACCACAGCCTCAGCGTCATGA |
| 6524 | MG3-6-mTRAC-target site-H2 | TAAATCCGGCTACTTTCAGCAG |
| 6525 | MG3-6-mTRAC-target site-A3 | AGGATTCGGAGTCCCATAACTG |
| 6526 | MG3-6-mTRAC-target site-B3 | ATAACTGACAGGTTTTGAAAGT |
| 6527 | MG3-6-mTRAC-target site-C3 | GTACTTCCTCACTCCAGGTCTG |
| 6528 | MG3-6-mTRAC-target site-D3 | CCACCTCGTCAAGACGGCTGTC |
| 6529 | MG3-6-mTRAC-target site-E3 | TGGCCCTGATTCACAATCCCAC |
| 6530 | MG3-6-mTRAC-target site-F3 | TTCACAATCCCACCTGGATCTC |
| 6531 | MG3-6-mTRAC-target site-G3 | CTGGATCTCCCAGATTTGTGAG |
| 6532 | MG3-6-mTRAC-target site-H3 | CATTCACAAAAAACGGCAGGGG |
| 6533 | MG3-6-mTRAC-target site-A4 | AACGGCAGGGGCGGGGCTTCTC |

TABLE 2B-continued

| List of sites targeted in Example 8 | | |
|---|---|---|
| SEQ ID NO: | Entity Name | Sequence |
| 6534 | MG3-6-mTRAC-target site-B4 | GGGCGGGGCTTCTCCTGGATCT |
| 6535 | MG3-6-mTRAC-target site-C4 | ATCTGAAGACCCCTCCCCCATG |
| 6536 | MG3-6-mTRAC-target site-D4 | GTTTTTTGTTTTTTTTTTTTTT |
| 6537 | MG3-6-mTRAC-target site-E4 | GGTGTAGAAATTATCTCATTGT |
| 6538 | MG3-6-mTRAC-target site-F4 | GGCTCAATACACACAGTAGCAG |
| 6539 | MG3-6-mTRAC-target site-G4 | ATTTTTTTTACAACATTCTCCA |
| 6540 | MG3-6-mTRAC-target site-H4 | ACAGGGGAGTCTGCCATGGGGG |
| 6541 | MG3-6-mTRAC-target site-A5 | GTCTGCCATGGGGGAGGGGTCT |
| 6542 | MG3-6-mTRAC-target site-B5 | AGCAACCTTCCTCACAAATCTG |
| 6543 | MG3-6-mTRAC-target site-C5 | TCACAAATCTGGGAGATCCAGG |
| 6544 | MG3-6-mTRAC-target site-D5 | AGATCCAGGTGGGATTGTGAAT |
| 6545 | MG3-6-mTRAC-target site-E5 | TGGGATTGTGAATCAGGGCCAA |
| 6546 | MG3-6-mTRAC-target site-F5 | GACAGCCGTCTTGACGAGGTGG |
| 6547 | MG3-6-mTRAC-target site-G5 | TGAGGAGGATGGAGCTTGGGAG |
| 6548 | MG3-6-mTRAC-target site-H5 | GGAGTCAGGCTCTGTCAGTCTT |

Example 9—Gene Editing Outcomes at the DNA Level for HPRT

Figure 3:
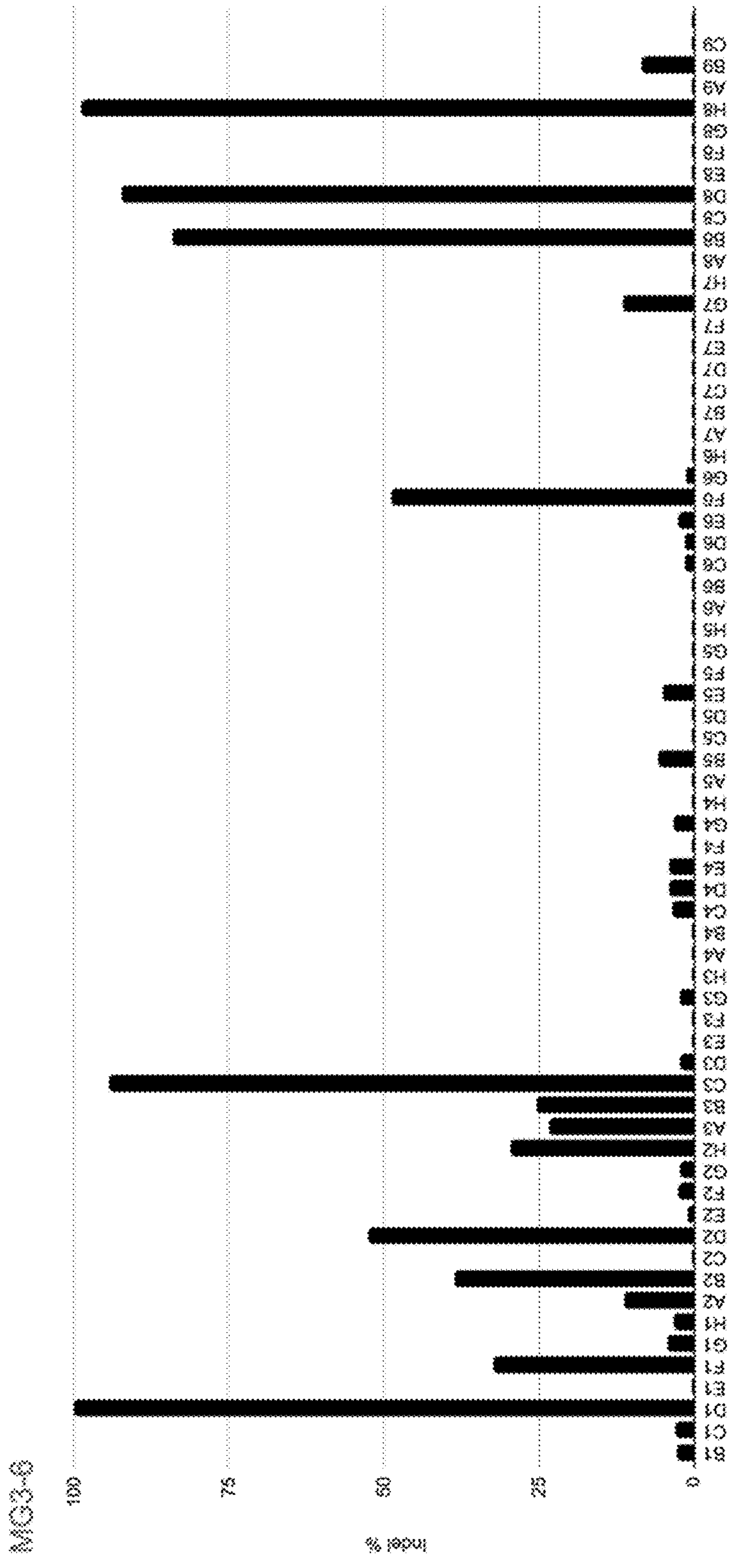
FIG. 3 depicts the gene editing outcomes at the DNA level for HPRT.

Primary T cells were purified from PBMCs using a negative selection kit (Miltenyi) according to the manufacturer's recommendations. Nucleofection of MG3-6 RNPs (126 pmol protein/160 pmol guide) (SEQ ID NOs: 6549-6615) was performed into T cells (200,000) using the Lonza 4D electroporator. Cells were harvested and genomic DNA prepared five days post-transfection. PCR primers appropriate for use in NGS-based DNA sequencing were generated, optimized, and used to amplify the individual target sequences for each guide RNA (SEQ ID NOs: 6616-6682). The amplicons were sequenced on an Illumina MiSeq machine and analyzed with a proprietary Python script to measure gene editing (FIG. 3).

TABLE 3A

| Guide sequences used in Example 9 | | |
|---|---|---|
| SEQ ID NO: | Entity Name | Sequence |
| 6549 | MG3-6-HPRT-sgRNA-A1 | mU*mU*mC*rCrUrCrUrGrCrArUrCrArGrUrUrUrArArUrGrGr UrUrGrArGrArArUrCrGrArArArGrArUrUrCrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |

TABLE 3A-continued

| SEQ ID NO: | Entity Name | Sequence |
|---|---|---|
| | Guide sequences used in Example 9 | |
| 6550 | MG3-6-HPRT-sgRNA-B1 | mG*mU*mG*rGrGrCrUrUrGrUrGrUrUrCrUrArArArGrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 6551 | MG3-6-HPRT-sgRNA-C1 | mA*mG*mG*rArGrUrGrArGrArUrUrGrGrUrUrUrUrUrUrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6552 | MG3-6-HPRT-sgRNA-D1 | mU*mA*mA*rArArArArUrArArUrArUrUrUrArUrArArUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6553 | MG3-6-HPRT-sgRNA-E1 | mG*mA*mG*rUrArUrUrUrUrUrArUrUrGrArArArArGrCrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6554 | MG3-6-HPRT-sgRNA-F1 | mA*mA*mA*rArArUrArUrUrUrUrCrCrCrUrArArCrArArArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6555 | MG3-6-HPRT-sgRNA-G1 | mA*mU*mC*rUrCrArGrCrUrArUrUrUrArGrUrCrArArArArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6556 | MG3-6-HPRT-sgRNA-H1 | mG*mUmC*rCrUrArCrUrUrUrUrGrArCrUrArArArUrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6557 | MG3-6-HPRT-sgRNA-A2 | mA*mA*mC*rUrCrUrCrCrArArUrArUrArGrGrUrGrGrCrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6558 | MG3-6-HPRT-sgRNA-B2 | mA*mU*mU*rUrUrUrCrCrCrArUrArArArUrUrCrArArGrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6559 | MG3-6-HPRT-sgRNA-C2 | mC*mC*mA*rGrGrArCrUrGrGrArUrUrUrUrGrUrArGrGrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6560 | MG3-6-HPRT-sgRNA-D2 | mU*mG*mC*rArCrCrUrArCrArArArArUrCrCrArGrUrCrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 6561 | MG3-6-HPRT-sgRNA-E2 | mG*mU*mA*rArGrArArUrGrCrCrArGrCrCrCrCrCrArGrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |

TABLE 3A-continued

Guide sequences used in Example 9

| SEQ ID NO: | Entity Name | Sequence |
|---|---|---|
| 6562 | MG3-6-HPRT-sgRNA-F2 | mA*mA*mG*rCrArGrUrArArGrArArUrGrCrCrArGrCrCrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6563 | MG3-6-HPRT-sgRNA-G2 | mG*mC*mU*rGrGrCrArUrUrCrUrUrArCrUrGrCrUrUrGrCrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6564 | MG3-6-HPRT-sgRNA-H2 | mU*mG*mC*rUrUrGrCrUrGrArGrGrGrCrCrArGrArUrGrArUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6565 | MG3-6-HPRT-sgRNA-A3 | mA*mU*mA*rGrArUrUrCrCrArGrArArUrArUrCrUrCrCrArUrGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrU*mU*mU*mU |
| 6566 | MG3-6-HPRT-sgRNA-B3 | mU*mG*mA*rCrArGrUrArUrUrGrCrArGrUrUrArUrArCrArUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6567 | MG3-6-HPRT-sgRNA-C3 | mC*mG*mA*rArArArGrUrArArUrGrUrArArUrCrUrCrArUrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6568 | MG3-6-HPRT-sgRNA-D3 | mG*mG*mA*rUrUrArUrArUrCrUrUrArArGrUrCrUrUrArUrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6569 | MG3-6-HPRT-sgRNA-E3 | mA*mA*mC*rArCrArUrGrArCrArArArArUrUrArUrUrUrArArGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrU*mU*mU*mU |
| 6570 | MG3-6-HPRT-sgRNA-F3 | mG*mU*mU*rUrGrUrCrCrUrGrArArUrArGrCrArUrGrGrCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6571 | MG3-6-HPRT-sgRNA-G3 | mC*mUmG*rArArUrArGrCrArUrGrGrCrArGrArGrGrArUrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6572 | MG3-6-HPRT-sgRNA-H3 | mA*mU*mC*rCrUrUrArUrUrCrUrUrArArUrUrUrUrGrCrArArGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrU*mU*mU*mU |
| 6573 | MG3-6-HPRT-sgRNA-A4 | mG*mC*mC*rCrCrCrUrUrGrCrArArArArUrUrArArGrArArUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6574 | MG3-6-HPRT-sgRNA-B4 | mG*mG*mU*rGrArGrGrArArGrUrGrArUrArGrGrArArGrGrGrGr<br>UrUrGrArGrArArUrCrGrArArArGrArUrUrCrUrUrArArUrArArGr |

TABLE 3A-continued

Guide sequences used in Example 9

| SEQ ID NO: | Entity Name | Sequence |
|---|---|---|
| | | GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6575 | MG3-6-HPRT-sgRNA-C4 | mG*mU*mG*rArUrArGrGrArArGrGrGrGrUrGrGrGrCrCrCrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6576 | MG3-6-HPRT-sgRNA-D4 | mG*mG*mA*rArGrGrGrGrUrGrGrGrCrCrCrUrGrArArGrArUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6577 | MG3-6-HPRT-sgRNA-E4 | mA*mA*mU*rUrCrCrArGrGrArGrGrUrCrCrArGrArUrCrUrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6578 | MG3-6-HPRT-sgRNA-F4 | mU*mC*mA*rUrCrArCrUrCrArArUrUrCrCrArGrGrArGrGrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6579 | MG3-6-HPRT-sgRNA-G4 | mC*mA*mG*rCrArUrUrCrArUrCrArCrUrCrArArUrUrCrCrArGrU rUrGrArGrArArUrCrGrArArArGrArUrUrCrUrUrArArUrArArGrG rCrArUrCrCrUrUrCrCrGrArUrGrCrUrGrArCrUrUrCrUrCrArCrC rGrUrCrCrGrUrUrUrUrCrCrArArUrArGrGrArGrCrGrGrGrCrGr GrUrArUrGrU*mU*mU*mU |
| 6580 | MG3-6-HPRT-sgRNA-H4 | mC*mA*mG*rCrArUrArGrGrUrArArGrGrUrGrArGrGrArGrGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6581 | MG3-6-HPRT-sgRNA-A5 | mA*mC*mA*rUrArArArArArCrUrGrCrArGrArCrUrGrArUrCrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6582 | MG3-6-HPRT-sgRNA-B5 | mA*mC*mC*rUrGrArCrCrCrCrUrArCrArUrArArArArArCrUrGrU rUrGrArGrArArUrCrGrArArArGrArUrUrCrUrUrArArUrArArGrG rCrArUrCrCrUrUrCrCrGrArUrGrCrUrGrArCrUrUrCrUrCrArCrC rGrUrCrCrGrUrUrUrUrCrCrArArUrArGrGrArGrCrGrGrGrCrGr GrUrArUrGrU*mU*mU*mU |
| 6583 | MG3-6-HPRT-sgRNA-C5 | mG*mA*mU*rCrArGrUrCrUrGrCrArGrUrUrUrUrUrArUrGrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrUxmU*mUmU |
| 6584 | MG3-6-HPRT-sgRNA-D5 | mU*mC*mU*rGrCrUrUrUrUrUrCrCrUrArArGrUrGrArUrUrArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6585 | MG3-6-HPRT-sgRNA-E5 | mA*mC*mA*rGrArUrArCrCrGrUrGrArUrUrUrUrUrUrCrArArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |

TABLE 3A-continued

| Guide sequences used in Example 9 | | |
|---|---|---|
| SEQ ID NO: | Entity Name | Sequence |
| 6586 | MG3-6-HPRT-sgRNA-F5 | mA*mC*mU*rGrCrUrGrArCrArUrArUrGrArCrUrCrArCrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 6587 | MG3-6-HPRT-sgRNA-G5 | mC*mA*mU*rArUrGrUrCrArGrCrArGrUrUrUrGrArCrUrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6588 | MG3-6-HPRT-sgRNA-H5 | mU*mA*mU*rCrArGrUrGrArGrUrUrUrUrCrUrUrUrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6589 | MG3-6-HPRT-sgRNA-A6 | mG*mC*mU*rUrArUrUrUrUrCrUrArCrArUrGrCrUrCrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6590 | MG3-6-HPRT-sgRNA-B6 | mU*mU*mA*rArArUrGrUrCrArArCrCrUrArCrUrGrUrGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mUxmU*mU |
| 6591 | MG3-6-HPRT-sgRNA-C6 | mG*mA*mG*rGrArUrUrArArArGrUrCrUrArUrGrCrCrArCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6592 | MG3-6-HPRT-sgRNA-D6 | mA*mA*mG*rArArCrArArCrArArArArGrArArUrArCrCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6593 | MG3-6-HPRT-sgRNA-E6 | mU*mG*mG*rUrArUrArUrGrCrUrGrUrGrGrArArUrUrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6594 | MG3-6-HPRT-sgRNA-F6 | mG*mA*mG*rArUrArGrArCrUrGrGrUrUrCrGrUrGrArGrCrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 6595 | MG3-6-HPRT-sgRNA-G6 | mG*mU*mA*rGrGrArCrArUrGrCrUrCrArArArCrArArUrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6596 | MG3-6-HPRT-sgRNA-H6 | mA*mU*mU*rArArGrCrArGrCrUrGrCrUrCrArCrUrArCrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6597 | MG3-6-HPRT-sgRNA-A7 | mG*mA*mG*rArUrGrGrArGrCrUrUrUrArUrUrArArArCrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6598 | MG3-6-HPRT-sgRNA-B7 | mG*mA*mA*rCrUrCrArGrCrArCrUrUrCrArUrArUrGrCrCrUrGrUrUrGrArGrArArUrCrGrArArArGrArUrUrCrUrUrArArUrArArGr |

TABLE 3A-continued

| Guide sequences used in Example 9 | | |
|---|---|---|
| SEQ ID NO: | Entity Name | Sequence |
| | | GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6599 | MG3-6-HPRT-sgRNA-C7 | mU*mG*mA*rGrUrUrCrUrCrUrUrGrArArCrUrCrCrUrArArUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6600 | MG3-6-HPRT-sgRNA-D7 | mA*mU*mU*rCrCrUrGrArGrUrUrCrArGrGrUrArGrGrGrArGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6601 | MG3-6-HPRT-sgRNA-E7 | mU*mA*mU*rArUrArUrGrUrUrUrArArArGrArGrCrUrGrGrArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6602 | MG3-6-HPRT-sgRNA-F7 | mG*mG*mU*rArUrGrArArArGrCrArUrArArGrUrUrUrCrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6603 | MG3-6-HPRT-sgRNA-G7 | mU*mG*mA*rGrArCrUrGrCrCrUrUrUrArArCrArUrCrUrGrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6604 | MG3-6-HPRT-sgRNA-H7 | mA*mA*mU*rArUrUrUrUrUrCrArArCrArGrGrCrArGrCrArUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6605 | MG3-6-HPRT-sgRNA-A8 | mC*mU*mC*rCrCrArCrArCrCrCrUrUrUrArUrArGrUrUrUrGrU rUrGrArGrArArUrCrGrArArArGrArUrUrCrUrUrArArUrArArGrG rCrArUrCrCrUrUrCrCrGrArUrGrCrUrGrArCrUrUrCrUrCrArCrC rGrUrCrCrGrUrUrUrCrCrArArUrArGrGrArGrCrGrGrGrCrGr GrUrArUrGrU*mU*mU*mU |
| 6606 | MG3-6-HPRT-sgRNA-B8 | mU*mA*mU*rArGrUrUrUrArGrGrGrArUrUrGrUrArUrUrUrCrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6607 | MG3-6-HPRT-sgRNA-C8 | mA*mG*mG*rGrArUrUrGrUrArUrUrUrCrCrArArGrGrUrUrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6608 | MG3-6-HPRT-sgRNA-D8 | mA*mG*mU*rGrUrCrArArUrGrArGrCrArArArGrArUrGrArArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |
| 6609 | MG3-6-HPRT-sgRNA-E8 | mC*mC*mA*rUrUrGrArArGrGrGrGrArGrCrUrArArUrArArGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrCrCrArArUrArGrGrArGrCrGrGrGrCrGr GrUrArUrGrU*mU*mU*mU |

TABLE 3A-continued

Guide sequences used in Example 9

| SEQ ID NO: | Entity Name | Sequence |
|---|---|---|
| 6610 | MG3-6-HPRT-sgRNA-F8 | mU*mG*mG*rArCrArCrArUrGrGrGrUrArGrUrCrArGrGrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6611 | MG3-6-HPRT-sgRNA-G8 | mC*mC*mU*rGrGrArArCrCrUrGrArArGrGrArCrArGrUrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6612 | MG3-6-HPRT-sgRNA-H8 | mG*mU*mG*rCrArGrGrUrCrUrCrArGrArArCrUrGrUrCrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6613 | MG3-6-HPRT-sgRNA-A9 | mA*mU*mG*rArArArUrGrGrArGrArGrCrUrArArArUrUrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6614 | MG3-6-HPRT-sgRNA-B9 | mG*mU*mC*rArCrUrUrUrUrArArCrArCrArCrCrCrArArGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6615 | MG3-6-HPRT-sgRNA-C9 | mU*mA*mG*rArGrArGrGrCrArCrArUrUrUrGrCrCrArGrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

Notations for chemical modifications: m = 2'O-methyl ribonucleotide (e.g mC = cytosine ribonucleotide with 2'-O Methyl in place of 2' hydroxyl); f = 2'-fluoro ribonucleotide (e.g fC = cytosine ribonucleotide with 2' fluorine in place of 2' hydroxyl); * = phosphorothioate bond; r: native RNA linkage comprising the sugar ribose (for example the ribose or RNA form of the A base is written rA), d: deoxyribose sugar (DNA) linkage (for example a deoxyribose form of the A base is written dA)

TABLE 3B

Sites targeted in Example 9

| SEQ ID NO: | Entity Name | Sequence |
|---|---|---|
| 6616 | MG3-6-HPRT-target site-A1 | TTCCTCTGCATCAGTTTTAATG |
| 6617 | MG3-6-HPRT-target site-B1 | GTGGGCTTGTGTTCTAAAGGAG |
| 6618 | MG3-6-HPRT-target site-C1 | AGGAGTGAGATTGGTTTTTTGT |
| 6619 | MG3-6-HPRT-target site-D1 | TAAAAAATAATATTTATAATTT |
| 6620 | MG3-6-HPRT-target site-E1 | GAGTATTTTTATTGAAAAGCAT |
| 6621 | MG3-6-HPRT-target site-F1 | AAAAATATTTTCCCTAACAAAG |
| 6622 | MG3-6-HPRT-target site-G1 | ATCTCAGCTATTTAGTCAAAAG |
| 6623 | MG3-6-HPRT-target site-H1 | GTCCTACTTTTGACTAAATAGC |

TABLE 3B-continued

Sites targeted in Example 9

| SEQ ID NO: | Entity Name | Sequence |
|---|---|---|
| 6624 | MG3-6-HPRT-target site-A2 | AACTCTCCAATATAGGTGGCTA |
| 6625 | MG3-6-HPRT-target site-B2 | ATTTTTCCCATAAATTCAAGAT |
| 6626 | MG3-6-HPRT-target site-C2 | CCAGGACTGGATTTTGTAGGTG |
| 6627 | MG3-6-HPRT-target site-D2 | TGCACCTACAAAATCCAGTCCT |
| 6628 | MG3-6-HPRT-target site-E2 | GTAAGAATGCCAGCCCCCAGGA |
| 6629 | MG3-6-HPRT-target site-F2 | AAGCAGTAAGAATGCCAGCCCC |
| 6630 | MG3-6-HPRT-target site-G2 | GCTGGCATTCTTACTGCTTGCT |
| 6631 | MG3-6-HPRT-target site-H2 | TGCTTGCTGAGGGCCAGATGAT |

TABLE 3B-continued

| SEQ ID NO: | Entity Name | Sequence |
|---|---|---|
| Sites targeted in Example 9 | | |
| 6632 | MG3-6-HPRT-target site-A3 | ATAGATTCCAG AATATCTCCAT |
| 6633 | MG3-6-HPRT-target site-B3 | TGACAGTATTG CAGTTATACAT |
| 6634 | MG3-6-HPRT-target site-C3 | CGAAAAGTAAT GTAATCTCATA |
| 6635 | MG3-6-HPRT-target site-D3 | GGATTATATCT TAAGTCTTATA |
| 6636 | MG3-6-HPRT-target site-E3 | AACACATGACA AAATTATTTAA |
| 6637 | MG3-6-HPRT-target site-F3 | GTTTGTCCTGA ATAGCATGGCA |
| 6638 | MG3-6-HPRT-target site-G3 | CTGAATAGCAT GGCAGAGGATT |
| 6639 | MG3-6-HPRT-target site-H3 | ATCCTTATTCT TAATTTTGCAA |
| 6640 | MG3-6-HPRT-target site-A4 | GCCCCCTTGCA AAATTAAGAAT |
| 6641 | MG3-6-HPRT-target site-B4 | GGTGAGGAAGT GATAGGAAGGG |
| 6642 | MG3-6-HPRT-target site-C4 | GTGATAGGAAG GGGTGGGCCCT |
| 6643 | MG3-6-HPRT-target site-D4 | GGAAGGGGTGG GCCCTGAAGAT |
| 6644 | MG3-6-HPRT-target site-E4 | AATTCCAGGAG GTCCAGATCTT |
| 6645 | MG3-6-HPRT-target site-F4 | TCATCACTCAA TTCCAGGAGGT |
| 6646 | MG3-6-HPRT-target site-G4 | CAGCATTCATC ACTCAATTCCA |
| 6647 | MG3-6-HPRT-target site-H4 | CAGCATAGGTA AGGTGAGGAGG |
| 6648 | MG3-6-HPRT-target site-A5 | ACATAAAAACT GCAGACTGATC |
| 6649 | MG3-6-HPRT-target site-B5 | ACCTGACCCCT ACATAAAAACT |
| 6650 | MG3-6-HPRT-target site-C5 | GATCAGTCTGC AGTTTTTATGT |
| 6651 | MG3-6-HPRT-target site-D5 | TCTGCTTTTTC CTAAGTGATTA |
| 6652 | MG3-6-HPRT-target site-E5 | ACAGATACCGT GATTTTTTCAA |
| 6653 | MG3-6-HPRT-target site-F5 | ACTGCTGACAT ATGACTCACTA |
| 6654 | MG3-6-HPRT-target site-G5 | CATATGTCAGC AGTTTGACTGT |
| 6655 | MG3-6-HPRT-target site-H5 | TATCAGTGAGT TTTTCTTTTAA |
| 6656 | MG3-6-HPRT-target site-A6 | GCTTATTTTTC TACATGCTCTT |
| 6657 | MG3-6-HPRT-target site-B6 | TTAAATGTCAA CCTACTGTGGC |
| 6658 | MG3-6-HPRT-target site-C6 | GAGGATTAAAG TCTATGCCACA |
| 6659 | MG3-6-HPRT-target site-D6 | AAGAACAACAA AAGAATACCCA |
| 6660 | MG3-6-HPRT-target site-E6 | TGGTATATGCT GTGGAATTGAG |
| 6661 | MG3-6-HPRT-target site-F6 | GAGATAGACTG GTTCGTGAGCG |
| 6662 | MG3-6-HPRT-target site-G6 | GTAGGACATGC TCAAACAATAC |
| 6663 | MG3-6-HPRT-target site-H6 | ATTAAGCAGCT GCTCACTACAA |
| 6664 | MG3-6-HPRT-target site-A7 | GAGATGGAGCT TTATTAAACAT |
| 6665 | MG3-6-HPRT-target site-B7 | GAACTCAGCAC TTCATATGCCT |
| 6666 | MG3-6-HPRT-target site-C7 | TGAGTTCTCTT GAACTCCTAAT |
| 6667 | MG3-6-HPRT-target site-D7 | ATTCCTGAGTT CAGGTAGGGAG |
| 6668 | MG3-6-HPRT-target site-E7 | TATATATGTTT AAAGAGCTGGA |
| 6669 | MG3-6-HPRT-target site-F7 | GGTATGAAAGC ATAAGTTTTCT |
| 6670 | MG3-6-HPRT-target site-G7 | TGAGACTGCCT TTAACATCTGT |
| 6671 | MG3-6-HPRT-target site-H7 | AATATTTTTCA ACAGGCAGCAT |
| 6672 | MG3-6-HPRT-target site-A8 | CTCCCACACCC TTTTATAGTTT |
| 6673 | MG3-6-HPRT-target site-B8 | TATAGTTTAGG GATTGTATTTC |
| 6674 | MG3-6-HPRT-target site-C8 | AGGGATTGTAT TTCCAAGGTTT |
| 6675 | MG3-6-HPRT-target site-D8 | AGTGTCAATGA GCAAAGATGAA |
| 6676 | MG3-6-HPRT-target site-E8 | CCATTGAAGGG GAGCTAATAAG |
| 6677 | MG3-6-HPRT-target site-F8 | TGGACACATGG GTAGTCAGGGT |
| 6678 | MG3-6-HPRT-target site-G8 | CCTGGAACCTG AAGGACAGTTC |
| 6679 | MG3-6-HPRT-target site-H8 | GTGCAGGTCTC AGAACTGTCCT |
| 6680 | MG3-6-HPRT-target site-A9 | ATGAAATGGAG AGCTAAATTAT |

TABLE 3B-continued

| Sites targeted in Example 9 | | |
|---|---|---|
| SEQ ID NO: | Entity Name | Sequence |
| 6681 | MG3-6-HPRT-target site-B9 | GTCACTTTTAA CACACCCAAGG |
| 6682 | MG3-6-HPRT-target site-C9 | TAGAGAGGCAC ATTTGCCAGTA |

Example 10—Gene Editing Outcomes at the DNA Level for Human TRBC1/2

Figure 4:
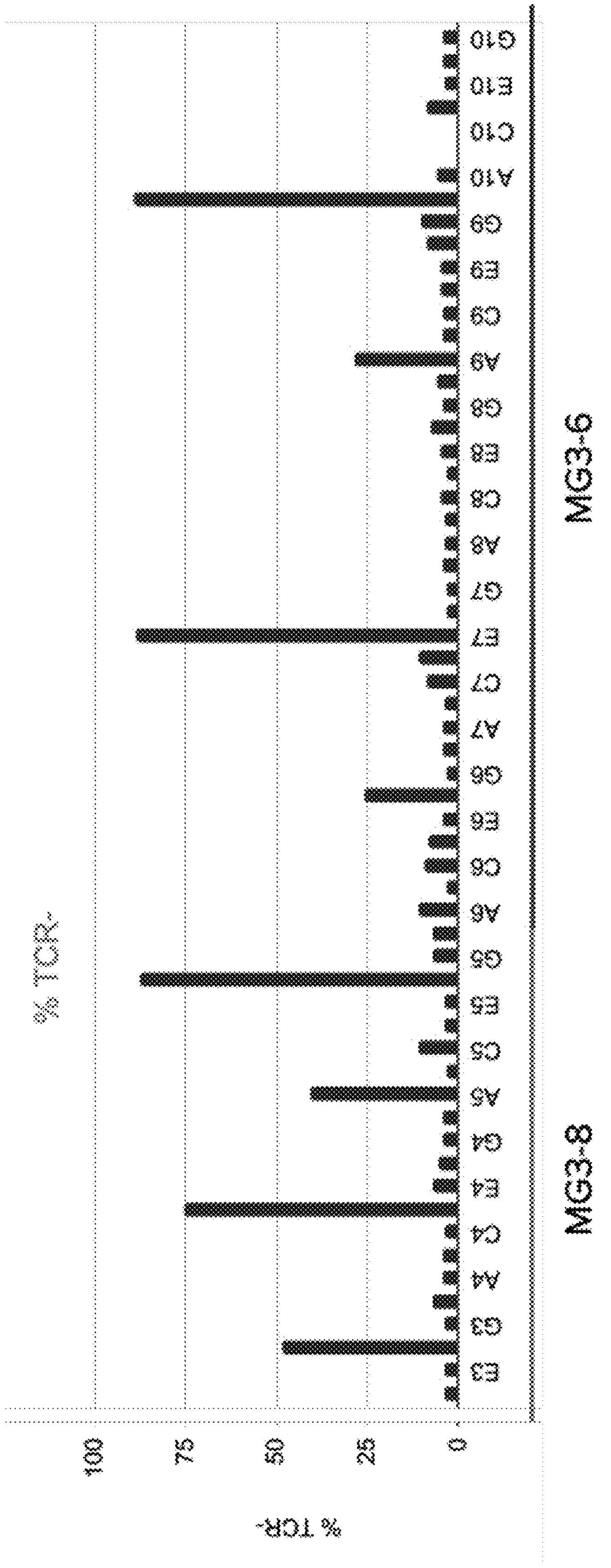
FIG. 4 depicts the flow cytometry results for gene editing of human TRBC1/2.

Primary T cells were purified from PBMCs using a negative selection kit (Miltenyi) according to the manufacturer's recommendations. Nucleofection of MG3-6 or MG3-8 RNPs (106 pmol protein/160 pmol guide) (MG3-6: SEQ ID NOs: 6683-6721; MG3-8: SEQ ID NOs: 6761-6781) was performed into T cells (200,000) using the Lonza 4D electroporator. For analysis by flow cytometry, 3 days post-nucleofection, 100,000 T cells were stained with anti-CD3 antibody for 30 minutes at 4° C. and analyzed on an Attune Nxt flow cytometer (FIG. 4).

TABLE 4A

| Guide sequences used in Example 10 | | |
|---|---|---|
| SEQ ID NO: | Entity Name | Sequence |
| 6683 | MG3-6-TRBC1/2-sgRNA-A6 | mA*mG*mG*rUrCrCrUrCrUrGrGrArArArGrGrGrArArGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6684 | MG3-6-TRBC1/2-sgRNA-B6 | mC*mA*mG*rGrUrCrCrUrCrUrGrGrArArArGrGrGrArArGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6685 | MG3-6-TRBC1/2-sgRNA-C6 | mC*mC*mA*rCrArCrUrGrGrUrGrUrGrCrCrUrGrGrCrCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6686 | MG3-6-TRBC1/2-sgRNA-D6 | mG*mA*mA*rUrGrGrGrArArGrGrArGrGrUrGrCrArCrArGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6687 | MG3-6-TRBC1/2-sgRNA-E6 | mU*mG*mA*rGrGrGrCrGrGrGrCrUrGrCrUrCrCrUrUrGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6688 | MG3-6-TRBC1/2-sgRNA-F6 | mA*mG*mU*rArUrCrUrGrGrArGrUrCrArUrUrGrArGrGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6689 | MG3-6-TRBC1/2-sgRNA-G6 | mA*mU*mA*rCrUrGrCrCrUrGrArGrCrArGrCrCrGrCrCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6690 | MG3-6-TRBC1/2-sgRNA-H6 | mU*mU*mG*rArCrArGrCrGrGrArArGrUrGrGrUrUrGrCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6691 | MG3-6-TRBC1/2-sgRNA-A7 | mC*mU*mU*rGrArCrArGrCrGrGrArArGrUrGrGrUrUrGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6692 | MG3-6-TRBC1/2-sgRNA-B7 | mC*mC*mG*rCrUrGrUrCrArArGrUrCrCrArGrUrUrCrUrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr |

TABLE 4A-continued

| Guide sequences used in Example 10 | | |
|---|---|---|
| SEQ ID NO: | Entity Name | Sequence |
| | | UrCrCrGrUrUrUrCrCrArArUrArGrGrArGrCrGrGrGrCrGrGrUr ArUrGrU*mU*mU*mU |
| 6693 | MG3-6-TRBC1/2-sgRNA-C7 | mU*mC*mG*rGrArGrArArUrGrArCrGrArGrUrGrGrArCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6694 | MG3-6-TRBC1/2-sgRNA-D7 | mC*mA*mG*rArUrCrGrUrCrArGrCrGrCrCrGrArGrGrCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6695 | MG3-6-TRBC1/2-sgRNA-E7 | mC*mG*mG*rCrGrCrUrGrArCrGrArUrCrUrGrGrGrUrGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6696 | MG3-6-TRBC1/2-sgRNA-F7 | mG*mC*mC*rArArCrArGrUrGrUrCrCrUrArCrCrArGrCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6697 | MG3-6-TRBC1/2-sgRNA-G7 | mC*mU*mU*rCrCrCrUrArGrCrArGrGrArUrCrUrCrArUrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6698 | MG3-6-TRBC1/2-sgRNA-H7 | mA*mU*mA*rCrArGrGrGrUrGrGrCrCrUrUrCrCrCrUrArGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6699 | MG3-6-TRBC1/2-sgRNA-A8 | mG*mG*mC*rGrCrUrGrArCrCrArGrCrArCrArGrCrArUrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6700 | MG3-6-TRBC1/2-sgRNA-B8 | mU*mC*mU*rCrUrUrCrUrGrCrArGrGrUrCrArArGrArGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6701 | MG3-6-TRBC1/2-sgRNA-C8 | mC*mC*mU*rGrCrArGrArArGrArGrArArArGrUrUrUrUrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6702 | MG3-6-TRBC1/2-sgRNA-D8 | mA*mC*mC*rUrGrCrArGrArArGrArGrArArArGrUrUrUrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6703 | MG3-6-TRBC1/2-sgRNA-E8 | mC*mC*mA*rCrArCrUrGrGrUrGrUrGrCrCrUrGrGrCrCrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |
| 6704 | MG3-6-TRBC1/2-sgRNA-F8 | mA*mC*mC*rArGrCrUrCrArGrCrUrCrCrArCrGrUrGrGrUrUr GrArGrArArUrCrGrArArArGrArUrUrCrUrUrArArUrArArGrGrCr ArUrCrCrUrUrCrCrGrArUrGrCrUrGrArCrUrUrCrUrCrArCrCrGr UrCrCrGrUrUrUrUrCrCrArArUrArGrGrArGrCrGrGrGrCrGrGrUr ArUrGrU*mU*mU*mU |

TABLE 4A-continued

| Guide sequences used in Example 10 | | |
|---|---|---|
| SEQ ID NO: | Entity Name | Sequence |
| 6705 | MG3-6-TRBC1/2-sgRNA-G8 | mG*mA*mA*rUrGrGrGrArArGrGrArGrGrUrGrCrArCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6706 | MG3-6-TRBC1/2-sgRNA-H8 | mU*mG*mA*rGrGrGrCrGrGrGrCrUrGrCrUrCrCrUrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6707 | MG3-6-TRBC1/2-sgRNA-A9 | mA*mG*mU*rArUrCrUrGrGrArGrUrCrArUrUrGrArGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6708 | MG3-6-TRBC1/2-sgRNA-B9 | mA*mU*mA*rCrUrGrCrCrUrGrArGrCrArGrCrCrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6709 | MG3-6-TRBC1/2-sgRNA-C9 | mU*mU*mG*rArCrArGrCrGrGrArArGrUrGrGrUrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6710 | MG3-6-TRBC1/2-sgRNA-D9 | mC*mU*mU*rGrArCrArGrCrGrGrArArGrUrGrGrUrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6711 | MG3-6-TRBC1/2-sgRNA-E9 | mC*mC*mG*rCrUrGrUrCrArArGrUrCrCrArGrUrUrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6712 | MG3-6-TRBC1/2-sgRNA-F9 | mU*mC*mG*rGrArGrArArUrGrArCrGrArGrUrGrGrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6713 | MG3-6-TRBC1/2-sgRNA-G9 | mC*mA*mG*rArUrCrGrUrCrArGrCrGrCrCrGrArGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6714 | MG3-6-TRBC1/2-sgRNA-H9 | mC*mG*mG*rCrGrCrUrGrArCrGrArUrCrUrGrGrGrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6715 | MG3-6-TRBC1/2-sgRNA-A10 | mG*mU*mC*rArArCrArGrArGrUrCrUrUrArCrCrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6716 | MG3-6-TRBC1/2-sgRNA-B10 | mC*mU*mU*rCrCrCrUrArGrCrArArGrArUrCrUrCrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

TABLE 4A-continued

Guide sequences used in Example 10

| SEQ ID NO: | Entity Name | Sequence |
|---|---|---|
| 6717 | MG3-6-TRBC1/2-sgRNA-C10 | mG*mC*mU*rGrArUrGrGrCrCrArUrGrGrUrArArGrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6718 | MG3-6-TRBC1/2-sgRNA-D10 | mU*mG*mU*rGrGrArArGrArGrArGrArArCrArUrUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6719 | MG3-6-TRBC1/2-sgRNA-E10 | mC*mU*mG*rUrGrGrArArGrArGrArGrArArCrArUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6720 | MG3-6-TRBC1/2-sgRNA-F10 | mU*mC*mU*rCrUrUrCrCrArCrArGrGrUrCrArArGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6721 | MG3-6-TRBC1/2-sgRNA-G10 | mA*mG*mG*rUrCrArArGrArGrArArArGrGrArUrUrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6761 | MG3-8-TRBC1/2-sgRNA-D3 | mA*mG*mG*rUrCrCrUrCrUrGrGrArArArGrGrGrArArGrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrU*mU*mU*mU |
| 6762 | MG3-8-TRBC1/2-sgRNA-E3 | mC*mU*mG*rArArCrArArGrGrUrGrUrUrCrCrCrArCrCrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrU*mU*mU*mU |
| 6763 | MG3-8-TRBC1/2-sgRNA-F3 | mC*mU*mC*rGrGrGrUrGrGrGrArArCrArCrCrUrUrGrUrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrU*mU*mU*mU |
| 6764 | MG3-8-TRBC1/2-sgRNA-G3 | mA*mA*mU*rGrGrGrArArGrGrArGrGrUrGrCrArCrArGrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrU*mU*mU*mU |
| 6765 | MG3-8-TRBC1/2-sgRNA-H3 | mG*mG*mG*rCrUrGrCrUrCrCrUrUrGrArGrGrGrGrCrUrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrU*mU*mU*mU |
| 6766 | MG3-8-TRBC1/2-sgRNA-A4 | mU*mA*mC*rUrGrCrCrUrGrArGrCrArGrCrCrGrCrCrUrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrU*mU*mU*mU |
| 6767 | MG3-8-TRBC1/2-sgRNA-B4 | mU*mU*mG*rArCrArGrCrGrGrArArGrUrGrGrUrUrGrCrGrUrUrGrArGrArArUrCrUrUrUrCrGrArArArGrArArArGrArUrUrCrUrUrArArUrArArGrGrCrArUrCrCrUrUrCrCrGrArUrGrCrUrGrArCrUrUrCrUrCrArCrCrGrUrCrCrGrGrCrUrCrCrUrCrUrUrArGrGrArArCrGrGrGrCrGrGrUrArUrGrUxmU*mU*mU |

TABLE 4A-continued

Guide sequences used in Example 10

| SEQ ID NO: | Entity Name | Sequence |
|---|---|---|
| 6768 | MG3-8-TRBC1/2-sgRNA-C4 | mG*mU*mG*rArCrGrGrGrUrUrUrGrGrCrCrCrUrArUrCrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6769 | MG3-8-TRBC1/2-sgRNA-D4 | mC*mG*mG*rCrGrCrUrGrArCrGrArUrCrUrGrGrGrUrGrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6770 | MG3-8-TRBC1/2-sgRNA-E4 | mC*mC*mA*rArCrArGrUrGrUrCrCrUrArCrCrArGrCrArGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6771 | MG3-8-TRBC1/2-sgRNA-F4 | mC*mC*mU*rGrCrArGrArArGrArGrArArArGrUrUrUrUrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6772 | MG3-8-TRBC1/2-sgRNA-G4 | mC*mU*mG*rArArArArArCrGrUrGrUrUrCrCrCrArCrCrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6773 | MG3-8-TRBC1/2-sgRNA-H4 | mC*mU*mU*rGrGrGrUrGrGrGrArArCrArCrGrUrUrUrUrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6774 | MG3-8-TRBC1/2-sgRNA-A5 | mA*mA*mU*rGrGrGrArArGrGrArGrGrUrGrCrArCrArGrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6775 | MG3-8-TRBC1/2-sgRNA-B5 | mG*mG*mG*rCrUrGrCrUrCrCrUrUrGrArGrGrGrGrCrUrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrUxmU*mU*mU |
| 6776 | MG3-8-TRBC1/2-sgRNA-C5 | mU*mA*mC*rUrGrCrCrUrGrArGrCrArGrCrCrGrCrCrUrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6777 | MG3-8-TRBC1/2-sgRNA-D5 | mU*mU*mG*rArCrArGrCrGrGrArArGrUrGrGrUrUrGrCrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6778 | MG3-8-TRBC1/2-sgRNA-E5 | mG*mU*mG*rArCrArGrGrUrUrUrGrGrCrCrCrUrArUrCrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6779 | MG3-8-TRBC1/2-sgRNA-F5 | mC*mG*mG*rCrGrCrUrGrArCrGrArUrCrUrGrGrGrUrGrGrUrUr<br>GrArGrArArUrCrUrUrUrCrGrArArArGrArArArGrArUrUrCrUrUr<br>ArArUrArArGrGrCrArUrCrCrUrUrCrCrGrArUrGrCrUrGrArCrUr<br>UrCrUrCrArCrCrGrUrCrCrGrGrCrUrCrCrUrCrUrUrArGrGrArAr<br>CrGrGrGrCrGrGrUrArUrGrU*mU*mU*mU |
| 6780 | MG3-8-TRBC1/2-sgRNA-G5 | mU*mC*mA*rArCrArGrArGrUrCrUrUrArCrCrArGrCrArGrUrUr<br>GrArGrArArUrCrUrUrUrCrGrArArArGrArArArGrArUrUrCrUrUr |

TABLE 4A-continued

Guide sequences used in Example 10

| SEQ ID NO: | Entity Name | Sequence |
|---|---|---|
| | | ArArUrArArGrGrCrArUrCrCrUrUrCrCrGrArUrGrCrUrGrArCrUr UrCrUrCrArCrCrGrUrCrCrGrGrCrUrCrCrUrCrUrUrArGrGrArAr CrGrGrGrCrGrGrUrArUrGrU*mU*mU*mU |
| 6781 | MG3-8-TRBC1/2-sgRNA-H5 | mU*mG*mU*rGrGrArArGrArGrArGrArArCrArUrUrUrUrGrUrUr GrArGrArArUrCrUrUrUrCrGrArArArGrArArArGrArUrUrCrUrUr ArArUrArArGrGrCrArUrCrCrUrUrCrCrGrArUrGrCrUrGrArCrUr UrCrUrCrArCrCrGrUrCrCrGrGrCrUrCrCrUrCrUrUrArGrGrArAr CrGrGrGrCrGrGrUrArUrGrUxmU*mU*mU |

Notations for chemical modifications: m = 2'O-methyl ribonucleotide (e.g mC = cytosine ribonucleotide with 2'-O Methyl in place of 2' hydroxyl); f = 2'-fluoro ribonucleotide (e.g fC = cytosine ribonucleotide with 2' fluorine in place of 2' hydroxyl); * = phosphorothioate bond; r: native RNA linkage comprising the sugar ribose (for example the ribose or RNA form of the A base is written rA), d: deoxyribose sugar (DNA) linkage (for example a deoxyribose form of the A base is written dA)

TABLE 4B

Sites targeted in Example 10

| SEQ ID NO: | Entity Name | Sequence |
|---|---|---|
| 6722 | MG3-6-TRBC1/2-target site-A6 | AGGTCCTCTGGAAAGGGAAG |
| 6723 | MG3-6-TRBC1/2-target site-B6 | CAGGTCCTCTGGAAAGGGAA |
| 6724 | MG3-6-TRBC1/2-target site-C6 | CCACACTGGTGTGCCTGGCC |
| 6725 | MG3-6-TRBC1/2-target site-D6 | GAATGGGAAGGAGGTGCACA |
| 6726 | MG3-6-TRBC1/2-target site-E6 | TGAGGGCGGGCTGCTCCTTG |
| 6727 | MG3-6-TRBC1/2-target site-F6 | AGTATCTGGAGTCATTGAGG |
| 6728 | MG3-6-TRBC1/2-target site-G6 | ATACTGCCTGAGCAGCCGCC |
| 6729 | MG3-6-TRBC1/2-target site-H6 | TTGACAGCGGAAGTGGTTGC |
| 6730 | MG3-6-TRBC1/2-target site-A7 | CTTGACAGCGGAAGTGGTTG |
| 6731 | MG3-6-TRBC1/2-target site-B7 | CCGCTGTCAAGTCCAGTTCT |
| 6732 | MG3-6-TRBC1/2-target site-C7 | TCGGAGAATGACGAGTGGAC |
| 6733 | MG3-6-TRBC1/2-target site-D7 | CAGATCGTCAGCGCCGAGGC |
| 6734 | MG3-6-TRBC1/2-target site-E7 | CGGCGCTGACGATCTGGGTG |
| 5735 | MG3-6-TRBC1/2-target site-F7 | GCCAACAGTGTCCTACCAGC |
| 6736 | MG3-6-TRBC1/2-target site-G7 | CTTCCCTAGCAGGATCTCAT |
| 6737 | MG3-6-TRBC1/2-target site-H7 | ATACAGGGTGGCCTTCCCTA |
| 6738 | MG3-6-TRBC1/2-target site-A8 | GGCGCTGACCAGCACAGCAT |

TABLE 4B-continued

Sites targeted in Example 10

| SEQ ID NO: | Entity Name | Sequence |
|---|---|---|
| 6739 | MG3-6-TRBC1/2-target site-B8 | TCTCTTCTGCAGGTCAAGAG |
| 6740 | MG3-6-TRBC1/2-target site-C8 | CCTGCAGAAGAGAAAGTTTT |
| 6741 | MG3-6-TRBC1/2-target site-D8 | ACCTGCAGAAGAGAAAGTTT |
| 6742 | MG3-6-TRBC1/2-target site-E8 | CCACACTGGTGTGCCTGGCC |
| 6743 | MG3-6-TRBC1/2-target site-F8 | ACCAGCTCAGCTCCACGTGG |
| 6744 | MG3-6-TRBC1/2-target site-G8 | GAATGGGAAGGAGGTGCACA |
| 6745 | MG3-6-TRBC1/2-target site-H8 | TGAGGGCGGGCTGCTCCTTG |
| 6746 | MG3-6-TRBC1/2-target site-A9 | AGTATCTGGAGTCATTGAGG |
| 6747 | MG3-6-TRBC1/2-target site-B9 | ATACTGCCTGAGCAGCCGCC |
| 6748 | MG3-6-TRBC1/2-target site-C9 | TTGACAGCGGAAGTGGTTGC |
| 6749 | MG3-6-TRBC1/2-target site-D9 | CTTGACAGCGGAAGTGGTTG |
| 6750 | MG3-6-TRBC1/2-target site-E9 | CCGCTGTCAAGTCCAGTTCT |
| 6751 | MG3-6-TRBC1/2-target site-F9 | TCGGAGAATGACGAGTGGAC |
| 6752 | MG3-6-TRBC1/2-target site-G9 | CAGATCGTCAGCGCCGAGGC |
| 6753 | MG3-6-TRBC1/2-target site-H9 | CGGCGCTGACGATCTGGGTG |

TABLE 4B-continued

| Sites targeted in Example 10 | | |
|---|---|---|
| SEQ ID NO: | Entity Name | Sequence |
| 6754 | MG3-6-TRBC1/2-target site-A10 | GTCAACAGAGTCTTACCAGC |
| 6755 | MG3-6-TRBC1/2-target site-B10 | CTTCCCTAGCAAGATCTCAT |
| 6756 | MG3-6-TRBC1/2-target site-C10 | GCTGATGGCCATGGTAAGGA |
| 6757 | MG3-6-TRBC1/2-target site-D10 | TGTGGAAGAGAGAACATTTT |
| 6758 | MG3-6-TRBC1/2-target site-E10 | CTGTGGAAGAGAGAACATTT |
| 6759 | MG3-6-TRBC1/2-target site-F10 | TCTCTTCCACAGGTCAAGAG |
| 6760 | MG3-6-TRBC1/2-target site-G10 | AGGTCAAGAGAAAGGATTCC |
| 6782 | MG3-8-TRBC1/2-target site-D3 | AGGTCCTCTGGAAAGGGAAG |
| 6783 | MG3-8-TRBC1/2-target site-E3 | CTGAACAAGGTGTTCCCACC |
| 6784 | MG3-8-TRBC1/2-target site-F3 | CTCGGGTGGGAACACCTTGT |
| 6785 | MG3-8-TRBC1/2-target site-G3 | AATGGGAAGGAGGTGCACAG |
| 6786 | MG3-8-TRBC1/2-target site-H3 | GGGCTGCTCCTTGAGGGGCT |
| 6787 | MG3-8-TRBC1/2-target site-A4 | TACTGCCTGAGCAGCCGCCT |
| 6788 | MG3-8-TRBC1/2-target site-B4 | TTGACAGCGGAAGTGGTTGC |
| 6789 | MG3-8-TRBC1/2-target site-C4 | GTGACGGGTTTGGCCCTATC |
| 6790 | MG3-8-TRBC1/2-target site-D4 | CGGCGCTGACGATCTGGGTG |
| 6791 | MG3-8-TRBC1/2-target site-E4 | CCAACAGTGTCCTACCAGCA |
| 6792 | MG3-8-TRBC1/2-target site-F4 | CCTGCAGAAGAGAAAGTTTT |
| 6793 | MG3-8-TRBC1/2-target site-G4 | CTGAAAAACGTGTTCCCACC |
| 6794 | MG3-8-TRBC1/2-target site-H4 | CTTGGGTGGGAACACGTTTT |
| 6795 | MG3-8-TRBC1/2-target site-A5 | AATGGGAAGGAGGTGCACAG |
| 6796 | MG3-8-TRBC1/2-target site-B5 | GGGCTGCTCCTTGAGGGGCT |
| 6797 | MG3-8-TRBC1/2-target site-C5 | TACTGCCTGAGCAGCCGCCT |

TABLE 4B-continued

| Sites targeted in Example 10 | | |
|---|---|---|
| SEQ ID NO: | Entity Name | Sequence |
| 6798 | MG3-8-TRBC1/2-target site-D5 | TTGACAGCGGAAGTGGTTGC |
| 6799 | MG3-8-TRBC1/2-target site-E5 | GTGACAGGTTTGGCCCTATC |
| 6800 | MG3-8-TRBC1/2-target site-F5 | CGGCGCTGACGATCTGGGTG |
| 6801 | MG3-8-TRBC1/2-target site-G5 | TCAACAGAGTCTTACCAGCA |
| 6802 | MG3-8-TRBC1/2-target site-H5 | TGTGGAAGAGAGAACATTTT |

Example 11—MG3-6 Guide Screen for Mouse HAO-1 Gene Using mRNA Transfection

Figure 5:
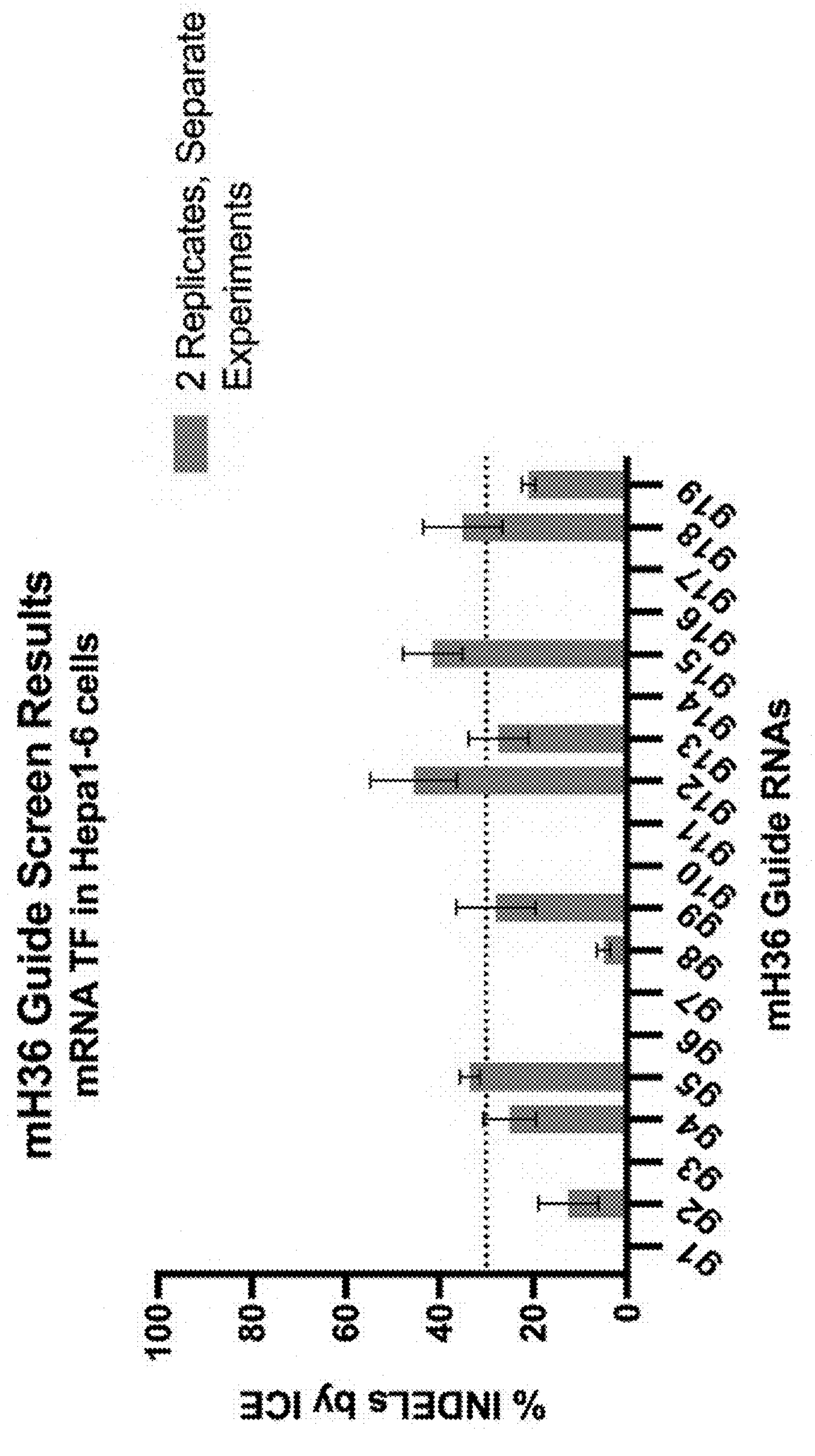
FIG. 5 depicts the results of a guide screen in Hepa1-6 cells; guides were delivered as mRNA and gRNA using lipofectamine Messenger Max.

Guides for MG3-6 were identified in exons 1, 2, 3, and 4 of the human HAO1 gene using a guide-finding algorithm that searches for the appropriate PAM sequence. A total of 19 guides were selected for evaluation in mammalian cells. 300 ng mRNA and 120 ng single guide RNA were transfected into Hepa1-6 cells as follows. One day prior to transfection, Hepa1-6 cells that had been cultured for less than 10 days in DMEM, 10% FBS, 1×NEAA media, without Pen/Step, were seeded into a TC-treated 24 well plate. Cells were counted, and the equivalent volume to 60,000 viable cells were added to each well. Additional pre-equilibrated media was added to each well to bring the total volume to 500 μL. On the day of transfection, 25 μL of OptiMEM media and 1.25 μL of Lipofectamine Messenger Max Solution (Thermo Fisher) were mixed in a mastermix solution, vortexed, and allowed to sit for at least 5 minutes at room temperature. In separate tubes, 300 ng of the MG3-6 mRNA and 120 ng of the sgRNA were mixed together with 25 μL of OptiMEM media and vortexed briefly. The appropriate volume of MessengerMax solution was added to each RNA solution, mixed by flicking the tube, and briefly spun down at a low speed. The complete editing reagent solutions were allowed to incubate for 10 minutes at room temperature, then added directly to the Hepa1-6 cells. Two days post transfection, the media was aspirated off of each well of Hepa1-6 cells and genomic DNA was purified by automated magnetic bead purification, via the KingFisher Flex with the MagMAX™ DNA Multi-Sample Ultra 2.0 Kit. The activity of the guides is summarized in Table 5A and FIG. 5, while the primers used are summarized in Table 5B.

TABLE 5A

Average Activity of MG3-6 guides at mouse HAO1 delivered by mRNA Transfection

| Guide Name | PAM | SEQ ID NO. | Spacer Sequence | Editing Activity (Average % INDELs) |
|---|---|---|---|---|
| mH36-1 | GCAGACC | 11802 | CATGCTGTTCATAATCACTGAT | 0 |
| mH36-2 | ACAGGTC | 11803 | CAGAAGTCAGTGTATGACTATT | 12.5 |
| mH36-3 | CCAGACC | 11804 | TAACGTCTCCTGATCATTTGCC | 0 |
| mH36-4 | ACAGATC | 11805 | CTCTGTCCTAAAACAGAAGTTG | 25 |
| mH36-5 | TGGGGCT | 11806 | GAGTCAGCATGCCAATATGTGT | 33.5 |
| mH36-6 | TCAGACC | 11807 | TTCTCCATTTCATTACAGCCTG | 0 |
| mH36-7 | ACAGGCT | 11808 | TCATGCCAGTTCCCATGGTCTG | 0 |
| mH36-8 | TTGGGCT | 11809 | GAACTGGCATGATGCTGAGTTC | 5 |
| mH36-9 | CTGGGCC | 11810 | AGTTGCATCCAGCGAAGTGCCT | 28 |
| mH36-10 | AAAGACC | 11811 | CTGGATGCAACTGTACATCTAC | 0 |
| mH36-11 | TGAGATC | 11812 | AACTGTACATCTACAAAGACCG | 0 |
| mH36-12 | CAGGGTT | 11813 | GATAGTGAAGCGAGCTGAGAAG | 45.5 |
| mH36-13 | CAAGGCC | 11814 | AGCGAGCTGAGAAGCAGGGTTA | 27.5 |
| mH36-14 | ACAGGTT | 11815 | AACCGCATTGATGACGTGCGGA | 0 |
| mH36-15 | TCAGGTC | 11816 | AGGTTCAAGCTGCCACCACAAC | 41.5 |
| mH36-16 | GTGGACT | 11817 | AAGGGAAATTTTGGAGACAACA | 0 |
| mH36-17 | ATAGACC | 11818 | TGCTGAATATGTGGCACAAGCT | 0 |
| mH36-18 | ATGGGTC | 11819 | GTAATATCATCCCAGCTGAGAG | 35 |
| mH36-19 | AGAGGTT | 11820 | TATTGTTGTAAAGGGCATTTTG | 21 |

TABLE 5B

Primers designed for the mouse HAO1 gene, used for PCR at each of the first four exons, and for sanger sequencing

| Target Exon | Use | Primer Name | SEQ ID NO. | Primer Sequence |
|---|---|---|---|---|
| Mouse | Fwd PCR | PCR mHE1_F_+233 | 11821 | GTGACCAACCCTACCCGTTT |
| HAO1 | Rev PCR | PCR mHE1_R_-553 | 11822 | GCAAGCACCTACTGTCTCGT |
| Exon 1 | Sequencing | Seq_mHE1_F_+139 | 11823 | GTCTAGGCATACAATGTTTGCTCA |
| Mouse | Fwd PCR | HAO1_E2_F5721 | 11824 | CAACGAAGGTTCCCTCCAGG |
| HAO1 | Rev PCR | HAO1_E2_R6271 | 11825 | GGAAGGGTGTTCGAGAAGGA |
| Exon 2 | Sequencing | 5938F_Seq_HAO1_E2 | 11826 | CTATGCAAGGAAAAGATTTGGCC |
| Mouse | Fwd PCR | HAO1_E3_F23198 | 11827 | TGCCCTAGACAAGCTGACAC |
| HAO1 | Rev PCR | HAO1_E3_R23879 | 11828 | CAGATTCTGGAAGTGGCCCA |
| Exon 3 | Sequencing | HAO1_E3_F23198 | 11827 | Same as Fwd PCR Primer |
| Mouse | Fwd PCR | PCR_mHE4_F_+300 | 11829 | GGCTGGCTGAAAATAGCATCC |
| HAO1 | Rev PCR | HAO1_E4_R31650 | 11830 | AGGTTTGGTTCCCCTCACCT |
| Exon 4 | Sequencing | PCR_mHE4_R_-149 | 11831 | TCTGCCATGAAGGCATATGGAC |

Example 12—Guide Chemistry Optimization for the MG3-6 Type II Nuclease (Prophetic)

Various chemically modified guides are designed and tested for activity. The most active guide in a guide screen in mouse hepatocytes (Hepa1-6 cells)—targeting albumin intron 1 is chosen as the spacer sequence model to insert various chemical modifications. The gRNA comprises the spacer located in the 5' followed by the CRISPR repeat and the trans-activating CRISPR RNA (tracr). The CRISPR repeat and the tracr are identical to MG3-6. The CRISPR repeat and tracr form a structured RNA comprising 3 stem loops. Different areas of the stem loops are modified by replacing the 2' hydroxyl in the ribose by 2'-O-methyl groups or replacing the phosphodiester backbone by a phosphorothioate (PS) bond. Moreover, the spacer in the 5' of the guide is modified by adding 2'-O-methyls, PS bonds, and 2'-fluoros. The editing activity of guides with the exact same base sequence but different chemical modifications is evaluated in Hepa1-6 cells by co-transfection of mRNA encoding MG3-6 and the guide. A guide with the same base sequence and a commercially available chemical modification called AltR1/AltR2 is used as a control. The spacer sequence in these guides targets a 22 nucleotide region in albumin intron1 of the mouse genome.

In order to test the stability of the chemically modified guides compared to the guide with no chemical modification (native RNA), a stability assay using crude cell extracts is used. Crude cell extracts from mammalian cells are selected because they contain the mixture of nucleases that a guide RNA will be exposed to when delivered to mammalian cells in vitro or in vivo. Hepa 1-6 cells are collected by adding 3 ml of cold PBS per 15 cm dish of confluent cells and releasing the cells from the surface of the dish using a cell scraper. The cells are pelleted at 200 g for 10 min and frozen at −80° C. for future use. For the stability assays, cells are resuspended in 4 volumes of cold PBS (e.g., for a 100 mg pellet cells are resuspended in 400 μL of cold PBS). Triton X-100 is added to a concentration of 0.2% (v/v), cells are vortexed for 10 seconds, put on ice for 10 minutes, and vortexed again for 10 seconds. Triton X-100 is a mild non-ionic detergent that disrupts cell membranes but does not inactivate or denature proteins at the concentration used. Stability reactions are set up on ice and comprise 20 μL of cell crude extract with 2 pmoles of each guide (1 μL of a 2 μM stock). Six reactions are set up per guide comprising: input, 0.5 hour, 1 hour, 4 hours, 9 hours, and in some cases 21 hours (The time in hours referring to the length of time each sample is incubated). Samples are incubated at 37° C. from 0.5 hours up to 21 hours while the input control is left on ice for 5 minutes. After each incubation period, the reaction is stopped by adding 300 μL of a mixture of phenol and guanidine thiocyanate (Tri reagent, Zymo Research) which immediately denatures all proteins and efficiently inhibits ribonucleases and facilitates the subsequent recovery of RNA. After adding Tri Reagent, the samples are vortexed for 15 seconds and stored at −20° C. RNA is extracted from the samples using Direct-zol RNA miniprep kit (Zymo Research) and eluted in 100 μL of nuclease-free water. Detection of the modified guide is performed using Tagman RT—qPCR using the Taqman miRNA Assay technology (Thermo Fisher). Data is plotted as a function of percentage of sgRNA remaining in relation to the input sample.

Example 13—Efficiency of mRNA Electroporation in T Cells

Figure 6:
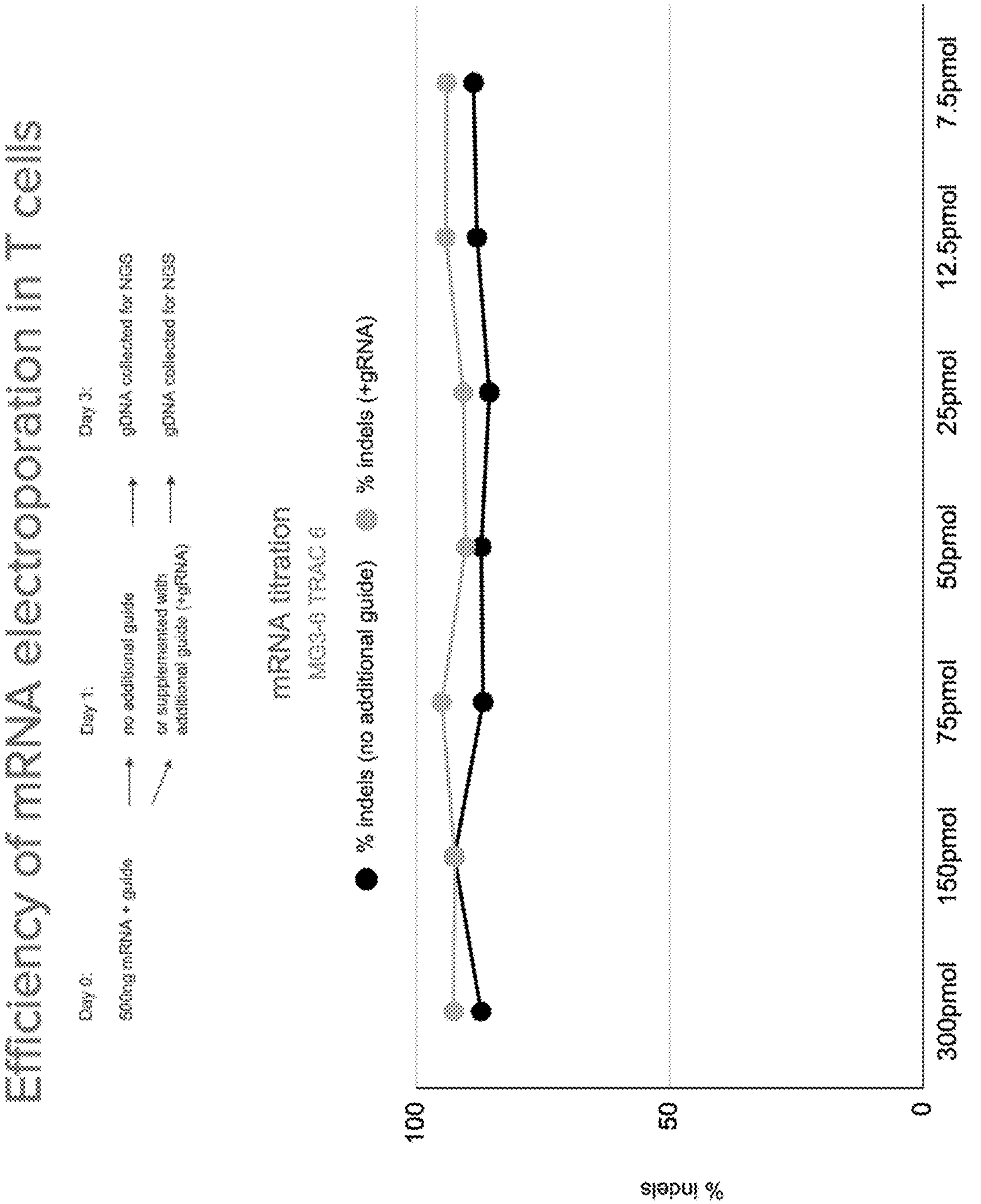
FIG. 6 depicts analysis of gene-editing outcomes by NGS for mRNA electroporation in T cells.

Primary T cells were purified from PBMCs using a negative selection kit (Miltenyi) according to the manufacturer's recommendations. Nucleofection of mRNA was performed as follow: 200,000 cells were co-transfected with 500 ng of mRNA and the indicated amount of guide RNA using a Lonza 4D electroporator (DS-120). Cells were harvested and genomic DNA prepared three days post initial transfection. For conditions labeled "+gRNA": 15 h post initial transfection, cells were nucleofected with indicated amount of additional guide. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing (FIG. 6).

Example 14—ELISA Assay to Assess Pre-Existing Antibody Response

MG3-6 and MG3-8 were expressed in and purified from human HEK293 cells using the Expi293™ Expression System Kit (ThermoFisher Scientific). Briefly, 293 cells were lipofected with plasmids encoding the nucleases driven by a strong viral promoter. Cells were grown in suspension culture with agitation and harvested two days post-transfection. The nuclease proteins were fused to a Six-His affinity tag and purified by metal-affinity chromatography to between 50-60% purity. Parallel lysates were made from mock-transfected cells and were subjected to an identical metal-affinity chromatography process. Cas9 was purchased from IDT and was >95% pure.

Figure 7:
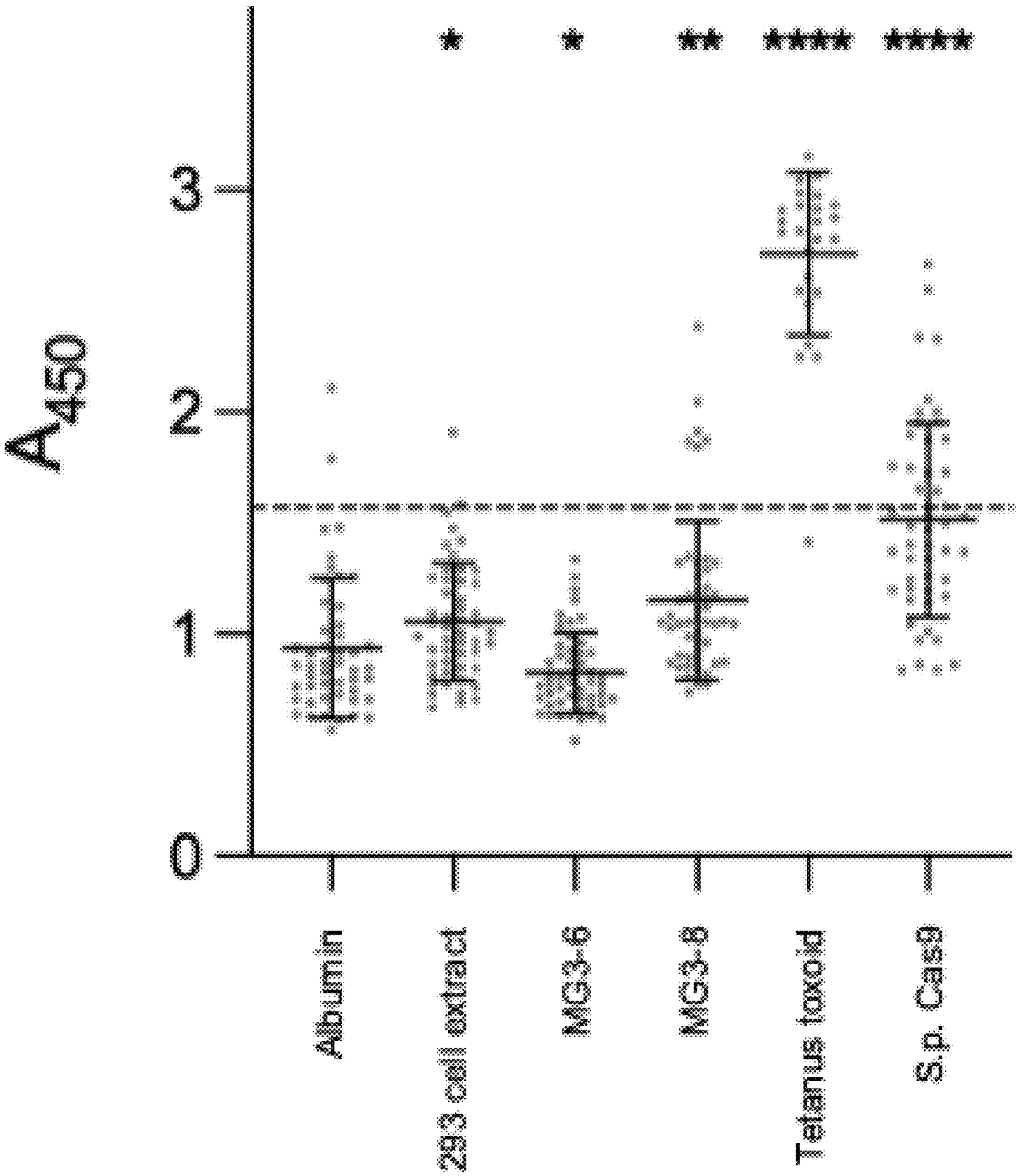
FIG. 7 depicts ELISA results from a screen performed at a serum dilution of 1:50 to detect antibodies against MG-3-6 and MG3-8 (n=50). Tetanus toxoid was used as the positive control due to wide-spread vaccination against this antigen. Serum samples above the dashed line were considered antibody-positive; the line represents the mean absorbance of the negative control (human albumin) plus two standard deviations from the mean. *P<0.05, P<0.01, **P<0.0001 as determined by an unpaired Student's t-test; ns, not significant.

MaxiSorp® ELISA plates (Thermo Scientific) were coated with 0.5 μg of nucleases or control proteins diluted in 1× phosphate buffered saline (PBS) and incubated overnight at room temperature. Plates were then washed and incubated with a 1% (w/v) bovine serum albumin (BSA) (Sigma-Aldrich)/1×PBS solution (1% BSA-PBS) for an hour at room temperature. After another washing step, wells were incubated for 1 h at room temperature with more than 50 separate serum samples taken from randomly selected donors (1:50 dilution in 1% BSA-PBS). Plates were then washed and incubated for an hour at room temperature with a peroxidase-labeled goat anti-human (Fcγ fragment-specific) secondary antibody (Jackson Immuno Research), diluted 1:50,000 in 1% BSA-PBS. The assay was developed using a 3,3',5,5'-Tetramethylbenzidine (TMB) Liquid Substrate System kit (Sigma-Aldrich), according to the manufacturer's specifications. Antibody titers are reported as absorbance values measured at 450 nm (FIG. 7). Tetanus toxoid was used as the positive control due to wide-spread vaccination against this antigen and was purchased from Sigma Aldrich.

Figure 8:
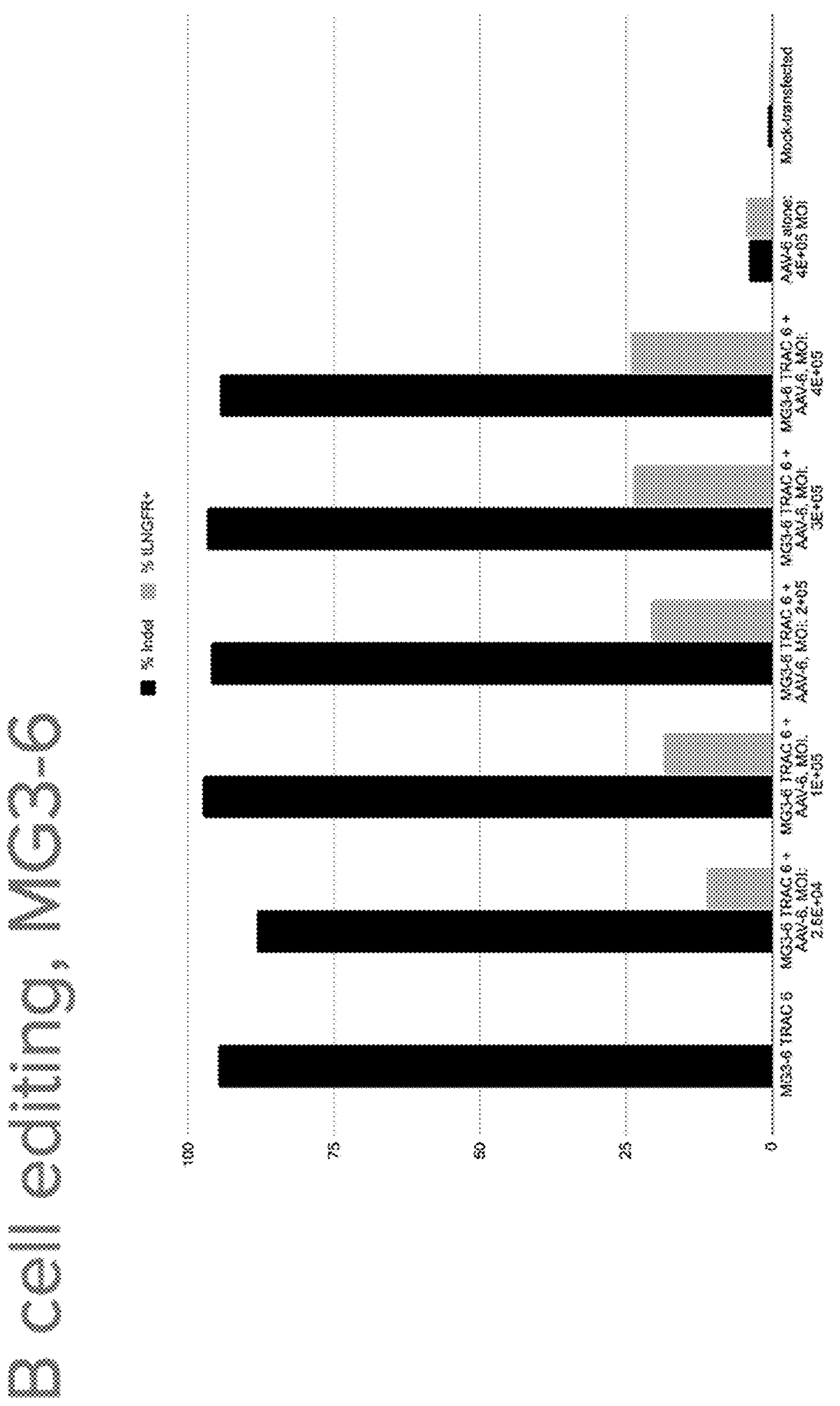
FIG. 8 depicts the gene editing outcomes at the DNA and cell-surface protein level for TRAC in human peripheral blood B cells.

Example 15—Gene Editing Outcomes at the DNA and Cell-Surface Protein Level for TRAC in Human Peripheral Blood B Cells Human Peripheral Blood B cells were purchased from STEMCELL Technologies and expanded using ImmunoCult™ Human B Cell Expansion Kit for 2 days prior to nucleofection. Nucleofection of MG3-6 RNPs (106 pmol protein/160 pmol guide) was performed into B cells (200,000) using the Lonza 4D electroporator. Post-nucleofection cells were immediately recovered into media containing AAV-6 sourced from Virovek. Cells were harvested and genomic DNA prepared five days post-transfection. For NGS analysis, PCR primers appropriate for use in NGS-based DNA sequencing were used to amplify the target sequence for the TRAC 6 guide RNA (SEQ ID NO: 6804). The amplicon was sequenced on an Illumina MiSeq machine and analyzed with a proprietary Python script to measure gene editing. For analysis by flow cytometry, 100,000 cells were stained for viability, expression of B cell surface marker CD19 (CD19 Monoclonal Antibody (HIB19), APC, eBioscience™) and for transgene (SEQ ID NO: 6810) insertion as measured by expression of tLNGFR (CD271 (LNGFR) Antibody, anti-human, REAfinity™). Cells were stained for 30 min at 4° C. and data was acquired on an Attune Nxt flow cytometer. Cells expressing tLNGFR were gated on single, live, CD19+ cells (FIG. 8).

TABLE 6

| SEQ ID NO: | Entity Name | Sequence |
|---|---|---|
| | | Guide sequences used in Example 15 |
| 6804 | MG3-6-TRAC-sgRNA-6 | mC*mG*mA*rArUrCrCrUrCrCrUrCrCrUrGrArArArGrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

Example 16—Gene Editing Outcomes at the DNA Level for TRAC and AAVS1 in Hematopoietic Stem Cells (HSCs)

Figure 9:
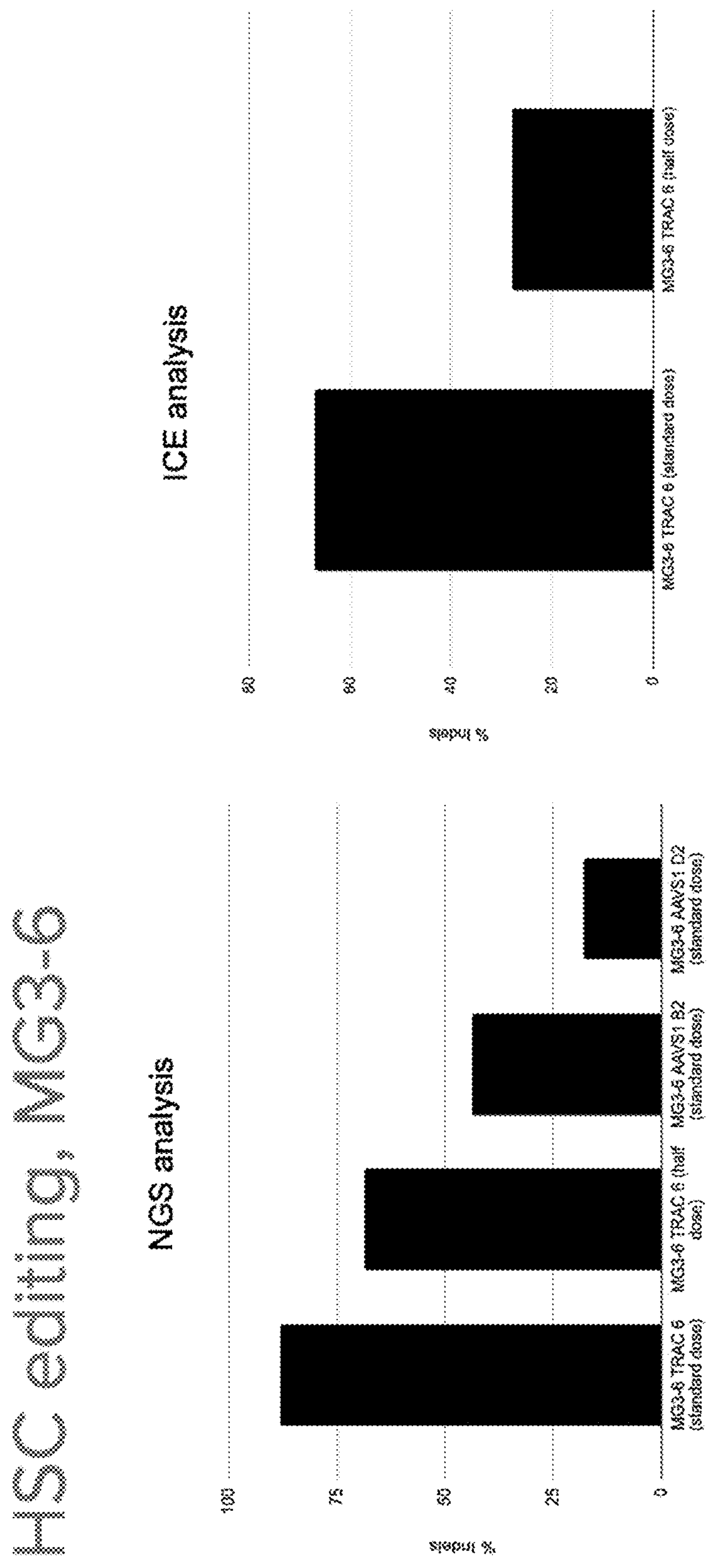
FIG. 9 depicts the gene editing outcomes at the DNA level for TRAC in hematopoietic stem cells.

Mobilized peripheral blood CD34+ cells were acquired from AllCells and cultured in STEMCELL StemSpan™ SFEM II media supplemented with StemSpan™ CC110 cytokine cocktail for 48 hours prior to nucleofection. Nucleofection of MG3-6 RNPs (106 pmol protein/120 pmol guide for standard dose, 52 pmol protein/60 pmol guide for half dose) was performed into HSCs (200,000) using the Lonza 4D electroporator. Cells were harvested and genomic DNA prepared three days post-transfection. PCR primers appropriate for use in Sanger and NGS-based DNA sequencing were generated, optimized, and used to amplify the individual target sequences for each guide RNA (SEQ ID NOs: 6804, 6806, and 6808). The NGS amplicons were sequenced on an Illumina MiSeq machine and analyzed with a proprietary Python script to measure gene editing. The ICE amplicons were sent to Elim Biopharmaceuticals Inc. for Sanger sequencing and analyzed with a proprietary Python script to measure gene editing (FIG. 9).

Example 17—Gene Editing Outcomes at the DNA and Cell-Surface Protein Level for TRAC in Induced Pluripotent Stem Cells (iPSCs) for MG3-6 Delivered as Ribonucleoprotein ATCC-BXS0116 Human [Non-Hispanic Caucasian Female] Induced Pluripotent Stem (IPS) Cells are cultured on Corning Matrigel-coated plasticware in mTESR Plus media (STEMCELL Technologies) containing 10 μM ROCK inhibitor Y-27632 for 24 hr prior to nucleofection. Nucleofection of MG3-6 RNPs (106 pmol protein/120 pmol guide) was performed into iPSCs (200,000) using the Lonza 4D electroporator. Cells were harvested with Accutase for flow cytometry and genomic DNA extraction five days post-transfection. PCR primers appropriate for use in NGS-based DNA sequencing were used to amplify the individual target sequences for the TRAC 6 gRNA (SEQ ID NO: 6804). The amplicons were sequenced on an Illumina MiSeq machine and analyzed with a proprietary Python script to measure gene editing. For analysis by flow cytometry, 5 days post-nucleofection 100,000 iPSCs per sample were stained with LIVE/DEAD™ Fixable Near-IR Dead Cell Stain Kit and CD271 (LNGFR) Antibody, anti-human, REAfinity™ to measure viability and transgene (SEQ ID NO: 6810) insertion, respectively. Cells were fixed and permeabilized

TABLE 7

| SEQ ID NO: | Entity Name | Sequence |
|---|---|---|
| | | Guide sequences used in Example 16 |
| 6804 | MG3-6-TRAC-sgRNA-6 | mC*mG*mA*rArUrCrCrUrCrCrUrCrCrUrGrArArArGrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6806 | MG3-6-AAVS1-sgRNA-B2 | mA*mG*mG*rArArUrCrUrGrCrCrUrArArCrArGrGrArGrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6808 | MG3-6-AAVS1-sgRNA-D2 | mU*mA*mG*rGrArArGrGrArGrGrArGrGrCrCrUrArArGrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

Figure 10:
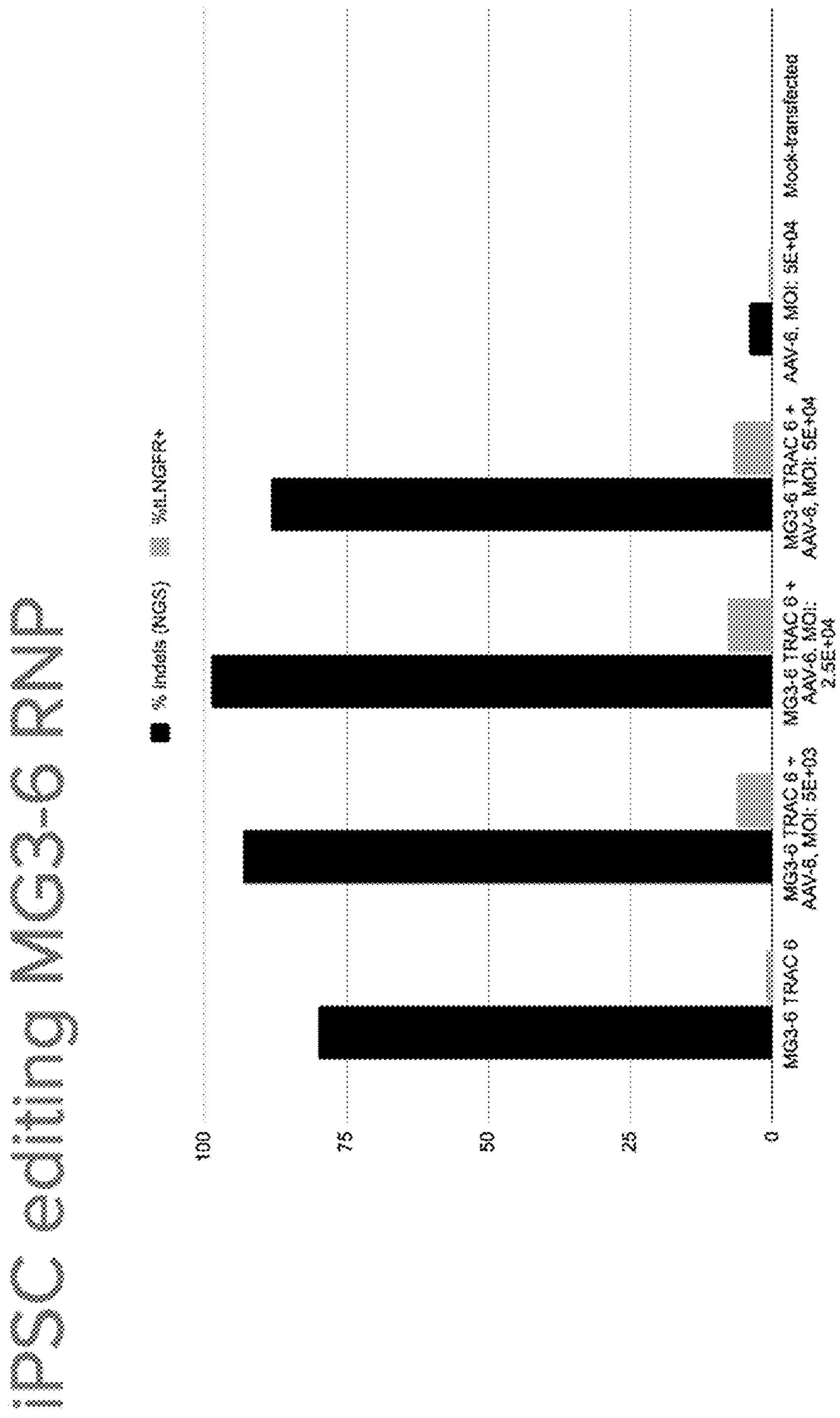
FIG. 10 depicts the gene editing outcomes at the DNA and cell-surface protein level for TRAC in induced pluripotent stem cells (iPSCs) for MG3-6 delivered as a ribonucleoprotein.

(Inside Stain Kit, Miltenyi) and further stained for pluripotency transcription factors Oct4 and Sox2 (Anti-Oct3/4 Isoform A-APC, human and mouse REA338 1: Anti-Sox2-FITC, human and mouse REA320. Cells were acquired on an Attune NxT flow cytometer, and analyzed for tLNGFR expression based on gating on single, live Oct4+Sox2+ cells (FIG. 10)

TABLE 8

Guide sequences used in Example 17

| SEQ ID NO: | Entity Name | Sequence |
|---|---|---|
| 6804 | MG3-6-TRAC-sgRNA-6 | mC*mG*mA*rArUrCrCrUrCrCrUrCrCrUrGrArArArGrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

Figure 11:
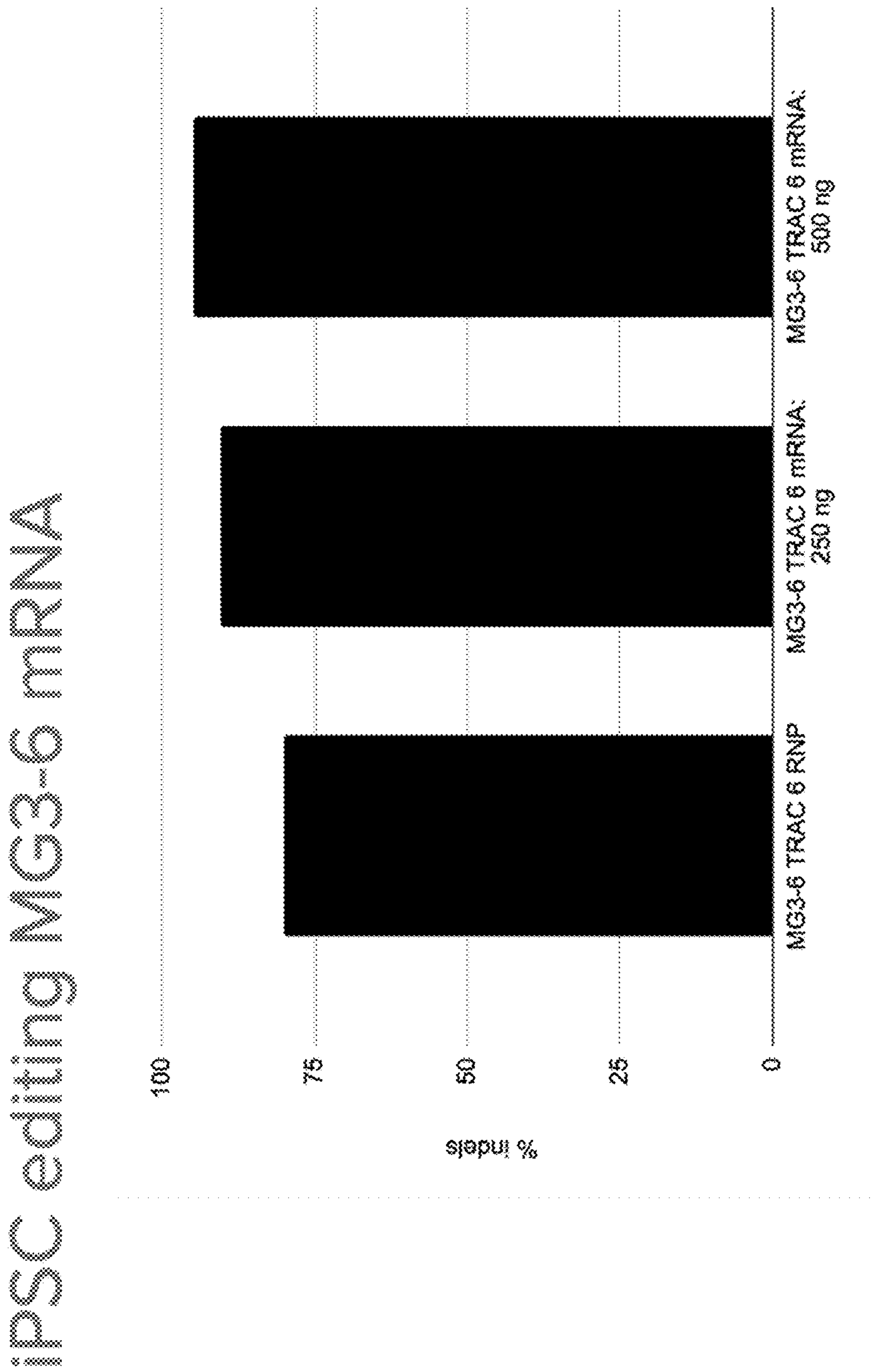
FIG. 11 depicts the gene editing outcomes at the DNA level for TRAC in induced pluripotent stem cells (iPSCs) for MG3-6 delivered as mRNA.

Example 18—Gene Editing Outcomes at the DNA Protein Level for TRAC in Induced Pluripotent Stem Cells (iPSCs) for MG3-6 Delivered as mRNA ATCC-BXS0116 Human [Non-Hispanic Caucasian Female] Induced Pluripotent Stem (IPS) Cells are cultured on Corning Matrigel-coated plasticware in mTESR Plus (STEMCELL Technologies) containing 10 μM ROCK inhibitor Y-27632 for 24 hr prior to nucleofection. Nucleofection of MG3-6 RNPs (106 pmol protein/120 pmol guide) or mRNA (250 or 500 ng mRNA/12 pmol guide) was performed into iPSCs (200,000) using the Lonza 4D electroporator. Cells were harvested with Accutase for genomic DNA extraction five days post-transfection. PCR primers appropriate for use in NGS-based DNA sequencing were used to amplify the individual target sequences for the TRAC 6 gRNA (SEQ ID NO: 6804). The amplicons were sequenced on an Illumina MiSeq machine and analyzed with a proprietary Python script to measure gene editing (FIG. 11).

TABLE 9

Guide sequences used in Example 18

| SEQ ID NO: | Entity Name | Sequence |
|---|---|---|
| 6804 | MG3-6-TRAC-sgRNA-6 | mC*mG*mA*rArUrCrCrUrCrCrUrCrCrUrGrArArArGrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

Example 19—Gene Editing Outcomes at the DNA Level for CD2

Figure 12:
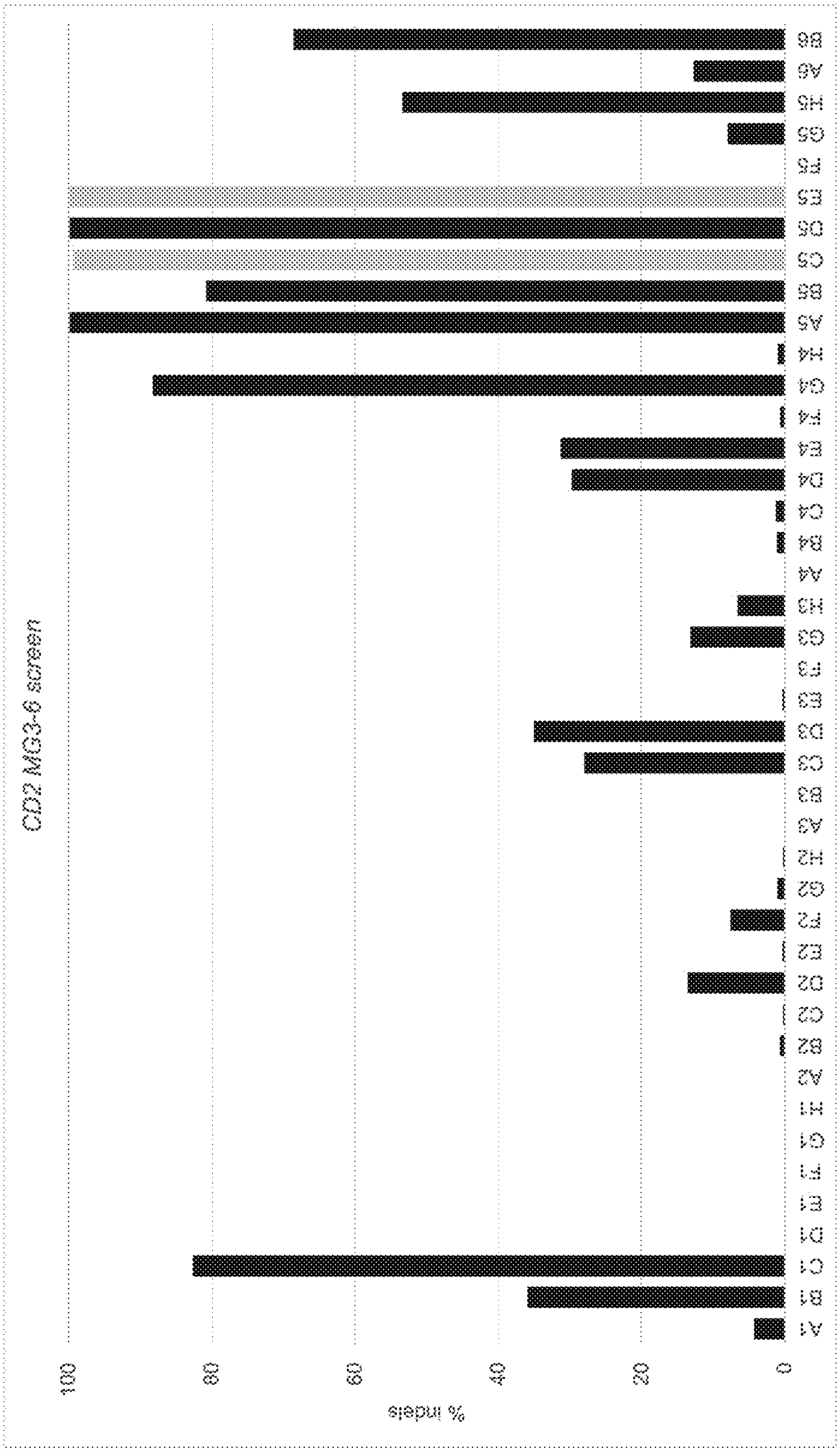
FIG. 12 depicts the gene editing outcomes at the DNA level for CD2 in primary T cells.

Primary T cells were purified from PBMCs using a negative selection kit (Miltenyi) according to the manufacturer's recommendations. Nucleofection of MG3-6 RNPs (106 pmol protein/160 pmol guide) was performed into T cells (200,000) using the Lonza 4D electroporator. Cells were harvested and genomic DNA prepared five days post-transfection. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing (FIG. 12).

TABLE 10A

Guide sequences used in Example 19

| SEQ ID NO: | Entity Name | Sequence |
| --- | --- | --- |
| 6811 | MG3-6-CD2-sgRNA-A1 | mA*mU*mU*rUrArCrArUrGrGrArArArGrCrUrCrArUrCrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6812 | MG3-6-CD2-sgRNA-B1 | mU*mU*mU*rUrUrArUrArGrGrUrGrCrArGrUrCrUrCrCrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6813 | MG3-6-CD2-sgRNA-C1 | mU*mG*mC*rCrUrUrGrGrArArArCrCrUrGrGrGrGrUrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6814 | MG3-6-CD2-sgRNA-D1 | mG*mG*mG*rArArArArArArCrUrUrCrArGrArCrArArGrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6815 | MG3-6-CD2-sgRNA-E1 | mU*mU*mG*rCrArCrArArUrUrCrArGrArArArArGrArGrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6816 | MG3-6-CD2-sgRNA-F1 | mG*mA*mA*rCrUrCrUrGrArArArArUrUrArArGrCrArUrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6817 | MG3-6-CD2-sgRNA-G1 | mU*mG*mU*rUrGrGrArArArArArArUrArUrUrUrGrArUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6818 | MG3-6-CD2-sgRNA-H1 | mU*mG*mA*rUrGrUrCrCrUrGrArCrCrCrArArGrGrCrArCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6819 | MG3-6-CD2-sgRNA-A2 | mC*mC*mA*rArGrGrCrArUrUrCrGrUrArArUrCrUrCrUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6820 | MG3-6-CD2-sgRNA-B2 | mU*mU*mU*rUrArGrArGrArGrGrGrUrCrUrCrArArArArCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6821 | MG3-6-CD2-sgRNA-C2 | mG*mG*mG*rUrCrUrCrArArArArCrCrArArArGrArUrCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6822 | MG3-6-CD2-sgRNA-D2 | mG*mG*mA*rArArCrArUrCrUrArArArArCrUrUrUrCrUrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6823 | MG3-6-CD2-sgRNA-E2 | mC*mU*mC*rArGrArGrGrGrUrCrArUrCrArCrArCrArCrArArGrUrUrGrArGrArArUrCrGrArArArGrArUrUrCrUrUrArArUrArArGr |

TABLE 10A-continued

Guide sequences used in Example 19

| SEQ ID NO: | Entity Name | Sequence |
|---|---|---|
| | | GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6824 | MG3-6-CD2-sgRNA-F2 | mC*mC*mG*rCrCrArCrGrCrArCrCrUrGrGrArCrArGrCrUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6825 | MG3-6-CD2-sgRNA-G2 | mU*mG*mG*rArCrArGrCrUrGrArCrArGrGrCrUrCrGrArCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6826 | MG3-6-CD2-sgRNA-H2 | mG*mC*mU*rGrUrGrCrArCrUrUrGrArArUrUrUrUrGrCrArCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6827 | MG3-6-CD2-sgRNA-A3 | mU*mU*mU*rArGrArUrGrUrUrCrCrCrArUrCrUrUrGrArUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6828 | MG3-6-CD2-sgRNA-B3 | mC*mC*mA*rUrCrUrUrGrArUrArCrArGrGrUrUrArArUrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6829 | MG3-6-CD2-sgRNA-C3 | mG*mG*mU*rCrArGrUrUrCrCrArUrCrArUrUrArCrCrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6830 | MG3-6-CD2-sgRNA-D3 | mU*mU*mC*rCrArUrUrCrArUrUrArCrCrUrCrArCrArGrGrUrGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrCrCrArArUrArGrGrArGrCrGrGrGrCrGr<br>GrUrArUrGrU*mU*mU*mU |
| 6831 | MG3-6-CD2-sgRNA-E3 | mG*mG*mG*rUrUrGrUrGrUrUrGrArUrArCrArArGrUrCrCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6832 | MG3-6-CD2-sgRNA-F3 | mA*mA*mG*rUrCrCrArGrGrArGrArUrCrUrUrUrGrGrUrUrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6833 | MG3-6-CD2-sgRNA-G3 | mG*mG*mC*rArGrCrArUrCrCrUrUrGrGrCrCrArGrArGrUrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |
| 6834 | MG3-6-CD2-sgRNA-H3 | mG*mC*mC*rArGrArGrUrArArUrGrGrGrCrUrCrUrCrUrGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrCrCrArArUrArGrGrArGrCrGrGrGrCrGr<br>GrUrArUrGrU*mU*mU*mU |

TABLE 10A-continued

Guide sequences used in Example 19

| SEQ ID NO: | Entity Name | Sequence |
|---|---|---|
| 6835 | MG3-6-CD2-sgRNA-A4 | mC*mA*mC*rUrUrCrUrCrUrUrCrCrUrUrUrUrGrCrArGrArGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6836 | MG3-6-CD2-sgRNA-B4 | mU*mA*mU*rArGrArArArArCrGrArGrCrArGrUrGrCrCrArCrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6837 | MG3-6-CD2-sgRNA-C4 | mA*mG*mC*rArGrUrGrCrCrArCrArArArGrArCrCrArUrCrArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6838 | MG3-6-CD2-sgRNA-D4 | mA*mU*mG*rCrCrArArUrGrArUrGrArGrArUrArGrArUrGrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrUmU*mU*mU |
| 6839 | MG3-6-CD2-sgRNA-E4 | mG*mA*mA*rGrArGrArArGrUrGrGrGrArUrGrGrCrUrGrGrGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6840 | MG3-6-CD2-sgRNA-F4 | mC*mC*mA*rCrArGrArGrUrArGrCrUrArCrUrGrArArGrArArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6841 | MG3-6-CD2-sgRNA-G4 | mC*mG*mU*rGrUrUrCrArGrCrArCrCrArGrCrCrUrCrArGrArGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6842 | MG3-6-CD2-sgRNA-H4 | mG*mG*mG*rCrArCrArCrArArGrUrUrCrArCrCrArGrCrArGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6843 | MG3-6-CD2-sgRNA-A5 | mC*mA*mG*rCrArGrArArArGrGrCrCrCrGrCrCrCrCrUrCrCrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6844 | MG3-6-CD2-sgRNA-B5 | mU*mG*mA*rGrUrUrUrUrCrUrGrCrUrGrCrCrCrCrArUrGrGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6845 | MG3-6-CD2-sgRNA-C5 | mA*mU*mG*rGrGrGrArGrGrUrUrUrUrGrGrCrUrGrArArCrUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6846 | MG3-6-CD2-sgRNA-D5 | mU*mG*mA*rArCrUrCrGrArGrGrUrCrUrGrGrGrGrArGrGrGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6847 | MG3-6-CD2-sgRNA-E5 | mA*mA*mC*rUrUrGrUrGrUrGrCrCrCrGrArCrGrGrArGrCrArGr UrUrGrArGrArArUrCrGrArArArGrArUrUrCrUrUrArArUrArArGr |

TABLE 10A-continued

Guide sequences used in Example 19

| SEQ ID NO: | Entity Name | Sequence |
|---|---|---|
| | | GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mUxmU*mU |
| 6848 | MG3-6-CD2-sgRNA-F5 | mC*mG*mA*rCrGrGrArGrCrArGrGrArGrGrCrCrUrCrUrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6849 | MG3-6-CD2-sgRNA-G5 | mG*mG*mA*rGrGrArGrGrArUrGrUrUrGrGrGrArArGrUrUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6850 | MG3-6-CD2-sgRNA-H5 | mG*mU*mU*rGrGrGrArArGrUrUrGrCrUrGrGrArUrUrCrUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6851 | MG3-6-CD2-sgRNA-A6 | mA*mG*mG*rGrGrUrUrGrArArGrCrUrGrGrArArUrUrUrGrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6852 | MG3-6-CD2-sgRNA-B6 | mC*mC*mC*rUrUrUrCrUrUrCrArGrUrArGrCrUrArCrUrCrUrGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrU*mU*mU*mU |

Notations for chemical modifications: m = 2'O-methyl ribonucleotide (e.g mC = cytosine ribonucleotide with 2'-O Methyl in place of 2' hydroxyl); f = 2'-fluoro ribonucleotide (e.g fC = cytosine ribonucleotide with 2' fluorine in place of 2' hydroxyl); * = phosphorothioate bond; r: native RNA linkage comprising the sugar ribose (for example the ribose or RNA form of the A base is written rA), d: deoxyribose sugar (DNA) linkage (for example a deoxyribose form of the A base is written dA)

TABLE 10B

Sites Targeted in Example 19

| SEQ ID NO: | Entity Name | Sequence |
|---|---|---|
| 6853 | MG3-6-CD2-target site-A1 | ATTTACATGGAAAGCTCATCTT |
| 6854 | MG3-6-CD2-target site-B1 | TTTTTATAGGTGCAGTCTCCAA |
| 6855 | MG3-6-CD2-target site-C1 | TGCCTTGGAAACCTGGGGTGCC |
| 6856 | MG3-6-CD2-target site-D1 | GGGAAAAAACTTCAGACAAGAA |
| 6857 | MG3-6-CD2-target site-E1 | TTGCACAATTCAGAAAAGAGAA |
| 6858 | MG3-6-CD2-target site-F1 | GAACTCTGAAAATTAAGCATCT |
| 6859 | MG3-6-CD2-target site-G1 | TGTTGGAAAAAATATTTGATTT |
| 6860 | MG3-6-CD2-target site-H1 | TGATGTCCTGACCCAAGGCACC |
| 6861 | MG3-6-CD2-target site-A2 | CCAAGGCATTCGTAATCTCTTT |
| 6862 | MG3-6-CD2-target site-B2 | TTTTAGAGAGGGTCTCAAAACC |
| 6863 | MG3-6-CD2-target site-C2 | GGGTCTCAAAACCAAAGATCTC |

TABLE 10B-continued

| SEQ ID NO: | Entity Name | Sequence |
|---|---|---|
| | Sites Targeted in Example 19 | |
| 6864 | MG3-6-CD2-target site-D2 | GGAAACATCTAAAACTTTCTCA |
| 6865 | MG3-6-CD2-target site-E2 | CTCAGAGGGTCATCACACACAA |
| 6866 | MG3-6-CD2-target site-F2 | CCGCCACGCACCTGGACAGCTG |
| 6867 | MG3-6-CD2-target site-G2 | TGGACAGCTGACAGGCTCGACA |
| 6868 | MG3-6-CD2-target site-H2 | GCTGTGCACTTGAATTTTGCAC |
| 6869 | MG3-6-CD2-target site-A3 | TTTAGATGTTTCCCATCTTGAT |
| 6870 | MG3-6-CD2-target site-B3 | CCATCTTGATACAGGTTTAATT |
| 6871 | MG3-6-CD2-target site-C3 | GGTCAGTTCCATTCATTACCTC |
| 6872 | MG3-6-CD2-target site-D3 | TTCCATTCATTACCTCACAGGT |
| 6873 | MG3-6-CD2-target site-E3 | GGGTTGTGTTGATACAAGTCCA |
| 6874 | MG3-6-CD2-target site-F3 | AAGTCCAGGAGATCTTTGGTTT |
| 6875 | MG3-6-CD2-target site-G3 | GGCAGCATCCTTGGCCAGAGTA |
| 6876 | MG3-6-CD2-target site-H3 | GCCAGAGTAATGGGCTCTCTGC |
| 6877 | MG3-6-CD2-target site-A4 | CACTTCTCTTCCTTTTGCAGAG |
| 6878 | MG3-6-CD2-target site-B4 | TATAGAAAACGAGCAGTGCCAC |
| 6879 | MG3-6-CD2-target site-C4 | AGCAGTGCCACAAAGACCATCA |
| 6880 | MG3-6-CD2-target site-D4 | ATGCCAATGATGAGATAGATGT |
| 6881 | MG3-6-CD2-target site-E4 | GAAGAGAAGTGGGATGGCTGGG |
| 6882 | MG3-6-CD2-target site-F4 | CCACAGAGTAGCTACTGAAGAA |
| 6883 | MG3-6-CD2-target site-G4 | CGTGTTCAGCACCAGCCTCAGA |
| 6884 | MG3-6-CD2-target site-H4 | GGGCACACAAGTTCACCAGCAG |
| 6885 | MG3-6-CD2-target site-A5 | CAGCAGAAAGGCCCGCCCCTCC |
| 6886 | MG3-6-CD2-target site-B5 | TGAGTTTTCTGCTGCCCCATGG |
| 6887 | MG3-6-CD2-target site-C5 | ATGGGGAGGTTTTGGCTGAACT |
| 6888 | MG3-6-CD2-target site-D5 | TGAACTCGAGGTCTGGGGAGGG |
| 6889 | MG3-6-CD2-target site-E5 | AACTTGTGTGCCCGACGGAGCA |
| 6890 | MG3-6-CD2-target site-F5 | CGACGGAGCAGGAGGCCTCTTC |
| 6891 | MG3-6-CD2-target site-G5 | GGAGGAGGATGTTGGGAAGTTG |
| 6892 | MG3-6-CD2-target site-H5 | GTTGGGAAGTTGCTGGATTCTG |
| 6893 | MG3-6-CD2-target site-A6 | AGGGGTTGAAGCTGGAATTTGG |
| 6894 | MG3-6-CD2-target site-B6 | CCCTTTCTTCAGTAGCTACTCT |

Example 20—Gene Editing Outcomes at the DNA Level for CD5

Figure 13:
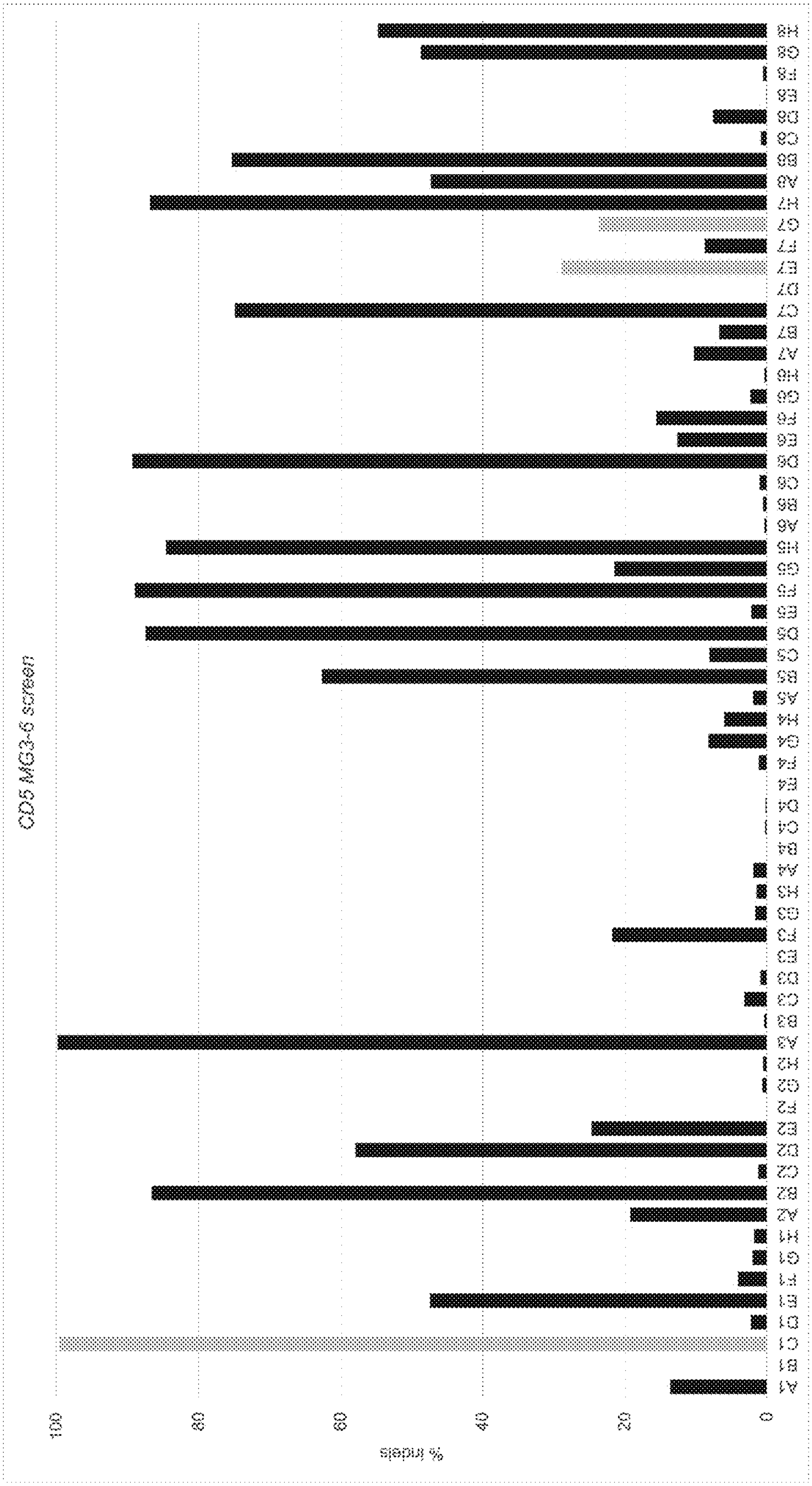
FIG. 13 depicts the gene editing outcomes at the DNA level for CD5 in primary T cells.

Primary T cells were purified from PBMCs using a negative selection kit (Miltenyi) according to the manufacturer's recommendations. Nucleofection of MG3-6 RNPs (106 pmol protein/160 pmol guide) was performed into T cells (200,000) using the Lonza 4D electroporator. Cells were harvested and genomic DNA prepared five days post-transfection. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing (FIG. 13).

TABLE 11A

Guide sequences used in Example 20

| SEQ ID NO: | Entity Name | Sequence |
|---|---|---|
| 6895 | MG3-6-CD5-sgRNA-A1 | mA*mG*mA*rArGrGrCrCrArGrArArArCrCrArUrGrCrCrCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6896 | MG3-6-CD5-sgRNA-B1 | mG*mU*mA*rCrArArGrGrUrGrGrCrCrArGrCrGrGrUrUrGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrUxmU*mU*mU |
| 6897 | MG3-6-CD5-sgRNA-C1 | mU*mU*mC*rUrGrArCrCrCrCrCrArGrArUrUrUrCrCrArGrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6898 | MG3-6-CD5-sgRNA-D1 | mC*mA*mC*rCrCrGrUrUrCrCrArArCrUrCrGrArArGrUrGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6899 | MG3-6-CD5-sgRNA-E1 | mA*mC*mU*rCrGrArArGrUrGrCrCrArGrGrGrCrCrArGrCrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6900 | MG3-6-CD5-sgRNA-F1 | mG*mC*mA*rCrArUrGrGrUrUrUrGrCrArGrCrCrArGrArGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6901 | MG3-6-CD5-sgRNA-G1 | mG*mG*mG*rCrCrGrGrArGrCrUrCrCrArArGrCrArGrUrGrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6902 | MG3-6-CD5-sgRNA-H1 | mC*mU*mC*rArArUrCrArUrCrUrGrCrUrArCrGrGrArCrArArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6903 | MG3-6-CD5-sgRNA-A2 | mC*mA*mG*rArArArUrGrArCrArUrGrUrGrUrCrArCrUrCrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6904 | MG3-6-CD5-sgRNA-B2 | mG*mG*mC*rUrGrGrCrUrArGrUrUrArCrCrCrArCrCrUrArArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6905 | MG3-6-CD5-sgRNA-C2 | mG*mC*mU*rArGrUrUrArCrCrCrArCrCrUrArArGrCrArGrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6906 | MG3-6-CD5-sgRNA-D2 | mU*mG*mA*rGrGrUrGrUrGrUrArGrGrUrGrArCrArArGrGrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6907 | MG3-6-CD5-sgRNA-E2 | mG*mU*mG*rUrArGrGrUrGrArCrArArGrGrArArGrGrGrGrCrGr<br>UrUrGrArGrArArUrCrGrArArArGrArUrUrCrUrUrArArUrArArGr |

TABLE 11A-continued

Guide sequences used in Example 20

| SEQ ID NO: | Entity Name | Sequence |
|---|---|---|
| | | GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6908 | MG3-6-CD5-sgRNA-F2 | mG*mC*mA*rCrCrCrCrArCrArGrUrUrCrArGrCrCrGrCrUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6909 | MG3-6-CD5-sgRNA-G2 | mU*mG*mG*rCrArGrArCrUrUrUrUrGrArCrGrCrUrUrGrArCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6910 | MG3-6-CD5-sgRNA-H2 | mC*mC*mA*rUrGrUrGrCrCrArUrCrCrGrUrCrCrUrUrGrArGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6911 | MG3-6-CD5-sgRNA-A3 | mG*mG*mU*rGrArGrCrCrUrUrGrCrCrUrGrGrArArArUrCrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6912 | MG3-6-CD5-sgRNA-B3 | mC*mA*mG*rArArGrArCrArArCrArCrCrUrCrCrArArCrGrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6913 | MG3-6-CD5-sgRNA-C3 | mC*mA*mA*rCrUrCrCrArGrArGrCrCrCrArCrArGrGrUrArArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6914 | MG3-6-CD5-sgRNA-D3 | mG*mG*mG*rCrUrCrUrGrGrArGrUrUrGrUrGrGrUrGrGrGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6915 | MG3-6-CD5-sgRNA-E3 | mU*mG*mU*rCrGrUrUrGrGrArGrGrUrGrUrUrGrUrCrUrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6916 | MG3-6-CD5-sgRNA-F3 | mC*mU*mC*rUrCrUrCrCrUrCrUrCrCrUrArGrCrUrCrCrUrCrGrU<br>rUrGrArGrArArUrCrGrArArArGrArUrUrCrUrUrArArUrArArGrG<br>rCrArUrCrCrUrUrCrCrGrArUrGrCrUrGrArCrUrUrCrUrCrArCrC<br>rGrUrCrCrGrUrUrUrUrCrCrArArUrArGrGrArGrCrGrGrGrCrGr<br>GrUrArUrGrUxmU*mU*mU |
| 6917 | MG3-6-CD5-sgRNA-G3 | mG*mC*mC*rUrGrGrGrGrGrUrArCrCrArUrCrArGrCrUrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6918 | MG3-6-CD5-sgRNA-H3 | mC*mC*mA*rUrCrArGrCrUrArUrGrArGrGrCrCrCrArGrGrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |

TABLE 11A-continued

Guide sequences used in Example 20

| SEQ ID NO: | Entity Name | Sequence |
|---|---|---|
| 6919 | MG3-6-CD5-sgRNA-A4 | mC*mU*mA*rUrGrArGrGrCrCrCrArGrGrArCrArArGrArCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6920 | MG3-6-CD5-sgRNA-B4 | mG*mC*mU*rCrCrUrUrCrUrUrGrArArGrCrArUrCrUrGrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6921 | MG3-6-CD5-sgRNA-C4 | mA*mG*mA*rGrArCrUrGrArGrGrCrArGrGrCrArGrArGrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6922 | MG3-6-CD5-sgRNA-D4 | mA*mC*mC*rArGrCrCrCrUrUrGrCrCrArArUrCrCrArArUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6923 | MG3-6-CD5-sgRNA-E4 | mU*mG*mC*rCrCrUrCrCrUrUrUrGrCrUrCrArGrGrUrArArGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6924 | MG3-6-CD5-sgRNA-F4 | mG*mG*mC*rArArGrArArCrUrCrGrGrCrCrArCrUrUrUrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6925 | MG3-6-CD5-sgRNA-G4 | mC*mC*mA*rGrGrGrArGrGrUrArCrArGrCrUrUrGrArGrUrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6926 | MG3-6-CD5-sgRNA-H4 | mA*mG*mC*rUrUrGrArGrUrUrCrUrGrGrArUrCrUrUrCrCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6927 | MG3-6-CD5-sgRNA-A5 | mC*mU*mG*rGrArUrCrUrUrCrCrArUrUrGrGrArUrUrGrGrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6928 | MG3-6-CD5-sgRNA-B5 | mG*mG*mC*rUrGrGrUrGrUrUrCrCrCrGrUrGrGrCrUrCrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrUxmU*mU*mU |
| 6929 | MG3-6-CD5-sgRNA-C5 | mG*mU*mU*rCrCrCrGrUrGrGrCrUrCrCrCrCrUrGrGrGrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6930 | MG3-6-CD5-sgRNA-D5 | mU*mG*mC*rUrUrCrArArGrArArGrGrArGrCrCrArCrArCrUrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6931 | MG3-6-CD5-sgRNA-E5 | mA*mG*mG*rUrUrGrUrUrGrCrArGrArGrGrArArGrUrUrCrUrGr<br>UrUrGrArGrArArUrCrGrArArArGrArUrUrCrUrUrArArUrArArGr |

TABLE 11A-continued

Guide sequences used in Example 20

| SEQ ID NO: | Entity Name | Sequence |
|---|---|---|
| | | GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6932 | MG3-6-CD5-sgRNA-F5 | mU*mG*mC*rArGrArGrGrArArGrUrUrCrUrCrCrArGrGrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrUxmU*mU*mU |
| 6933 | MG3-6-CD5-sgRNA-G5 | mU*mC*mU*rCrCrArGrGrUrCrCrUrGrGrGrUrCrUrUrGrUrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6934 | MG3-6-CD5-sgRNA-H5 | mG*mC*mC*rUrCrArUrArGrCrUrGrArUrGrGrUrArCrCrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6935 | MG3-6-CD5-sgRNA-A6 | mC*mA*mC*rGrCrCrGrGrCrArCrArGrUrGrCrUrGrGrCrCrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6936 | MG3-6-CD5-sgRNA-B6 | mA*mA*mG*rGrCrArCrCrGrUrGrGrArGrGrUrGrCrGrCrCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6937 | MG3-6-CD5-sgRNA-C6 | mG*mA*mC*rGrCrUrGrGrUrGrArCrCrCrArArCrArUrCrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6938 | MG3-6-CD5-sgRNA-D6 | mG*mG*mA*rCrArGrArArGrArGrCrCrCrCrCrGrGrGrArUrGrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6939 | MG3-6-CD5-sgRNA-E6 | mU*mC*mC*rUrGrGrCrUrGrArArGrArGrCrUrGrUrCrArCrArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6940 | MG3-6-CD5-sgRNA-F6 | mC*mC*mC*rCrArCrCrArGrArCrGrGrCrUrCrUrGrCrArCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6941 | MG3-6-CD5-sgRNA-G6 | mC*mC*mC*rArGrGrCrCrArGrGrArUrCrCrArArArCrCrCrCrGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |
| 6942 | MG3-6-CD5-sgRNA-H6 | mU*mU*mC*rArCrUrArGrCrUrUrCrUrUrGrUrArGrGrCrArArGr<br>UrUrGrArGrArArUrCrGrArArArGrArUrUrCrUrUrArArUrArArGr<br>GrCrArUrCrCrUrUrCrCrGrArUrGrCrUrGrArCrUrUrCrUrCrArCr<br>CrGrUrCrCrGrUrUrUrUrCrCrArArUrArGrGrArGrCrGrGrGrCrGr<br>GrUrArUrGrU*mU*mU*mU |

TABLE 11A-continued

Guide sequences used in Example 20

| SEQ ID NO: | Entity Name | Sequence |
|---|---|---|
| 6943 | MG3-6-CD5-sgRNA-A7 | mC*mC*mA*rGrCrArGrCrArCrCrArCrCrArGrGrArGrCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6944 | MG3-6-CD5-sgRNA-B7 | mA*mU*mG*rCrUrUrGrCrCrArCrCrGrUrGrCrCrUrGrCrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6945 | MG3-6-CD5-sgRNA-C7 | mA*mC*mC*rGrUrGrCrCrUrGrCrGrGrCrCrArGrGrCrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6946 | MG3-6-CD5-sgRNA-D7 | mC*mC*mU*rGrCrGrGrCrCrArGrGrCrCrUrGrCrGrGrGrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6947 | MG3-6-CD5-sgRNA-E7 | mU*mC*mC*rGrCrCrArGrArArGrArArGrCrArGrCrGrCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUmU*mU*mU |
| 6948 | MG3-6-CD5-sgRNA-F7 | mU*mU*mA*rCrUrGrUrUrUrGrGrUrUrCrArUrUrCrCrCrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6949 | MG3-6-CD5-sgRNA-G7 | mU*mC*mC*rArCrUrGrGrCrGrCrUrGrCrUrUrCrUrUrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6950 | MG3-6-CD5-sgRNA-H7 | mA*mG*mC*rUrGrArCrArGrGrUrGrGrGrArGrUrUrCrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6951 | MG3-6-CD5-sgRNA-A8 | mG*mG*mC*rUrGrUrArUrUrCrGrUrUrArUrCrCrArCrGrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6952 | MG3-6-CD5-sgRNA-B8 | mUmC*mG*rUrUrArUrCrCrArCrGrUrGrGrGrArGrGrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6953 | MG3-6-CD5-sgRNA-C8 | mG*mG*mA*rGrGrCrUrGrUrGrGrGrGrUrUrCrUrCrArGrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6954 | MG3-6-CD5-sgRNA-D8 | mC*mC*mU*rUrUrCrUrUrUrCrCrCrCrArGrCrUrCrUrGrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 6955 | MG3-6-CD5-sgRNA-E8 | mC*mC*mG*rArCrArGrUrGrArCrUrArUrGrArUrCrUrGrCrArGrUrUrGrArGrArArUrCrGrArArArGrArUrUrCrUrUrArArUrArArGr |

TABLE 11A-continued

| Guide sequences used in Example 20 | | |
|---|---|---|
| SEQ ID NO: | Entity Name | Sequence |
| | | GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrUmUxmU*mU |
| 6956 | MG3-6-CD5-sgRNA-F8 | mG*mA*mC*rUrArUrGrArUrCrUrGrCrArUrGrGrGrGrCrUrCrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6957 | MG3-6-CD5-sgRNA-G8 | mC*mU*mU*rUrArCrArGrCrCrUrCrUrGrArGrCrCrCrCrArUrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |
| 6958 | MG3-6-CD5-sgRNA-H8 | mA*mU*mA*rGrUrCrArCrUrGrUrCrGrGrArGrGrArGrUrUrGrGr UrUrGrArGrArArUrCrGrArArArGrArUrUrCrUrUrArArUrArArGr GrCrArUrCrCrUrUrCrCrGrArUrGrCrUrGrArCrUrUrCrUrCrArCr CrGrUrCrCrGrUrUrUrUrCrCrArArUrArGrGrArGrCrGrGrGrCrGr GrUrArUrGrU*mU*mU*mU |

Notations for chemical modifications: m = 2'O-methyl ribonucleotide (e.g mC = cytosine ribonucleotide with 2'-O Methyl in place of 2' hydroxyl); f = 2'-fluoro ribonucleotide (e.g fC = cytosine ribonucleotide with 2' fluorine in place of 2' hydroxyl); * = phosphorothioate bond; r: native RNA linkage comprising the sugar ribose (for example the ribose or RNA form of the A base is written rA), d: deoxyribose sugar (DNA) linkage (for example a deoxyribose form of the A base is written dA)

TABLE 11B

| Sites Targeted in Example 20 | | |
|---|---|---|
| SEQ ID NO: | Entity Name | Sequence |
| 6959 | MG3-6-CD5-target site-A1 | AGAAGGCCAGAAACCATGCCCA |
| 6960 | MG3-6-CD5-target site-B1 | GTACAAGGTGGCCAGCGGTTGC |
| 6961 | MG3-6-CD5-target site-C1 | TTCTGACCCCCAGATTTCCAGG |
| 6962 | MG3-6-CD5-target site-D1 | CACCCGTTCCAACTCGAAGTGC |
| 6963 | MG3-6-CD5-target site-E1 | ACTCGAAGTGCCAGGGCCAGCT |
| 6964 | MG3-6-CD5-target site-F1 | GCACATGGTTTGCAGCCAGAGC |
| 6965 | MG3-6-CD5-target site-G1 | GGGCCGGAGCTCCAAGCAGTGG |
| 6966 | MG3-6-CD5-target site-H1 | CTCAATCATCTGCTACGGACAA |
| 6967 | MG3-6-CD5-target site-A2 | CAGAAATGACATGTGTCACTCT |
| 6968 | MG3-6-CD5-target site-B2 | GGCTGGCTAGTTACCCACCTAA |
| 6969 | MG3-6-CD5-target site-C2 | GCTAGTTACCCACCTAAGCAGG |
| 6970 | MG3-6-CD5-target site-D2 | TGAGGTGTGTAGGTGACAAGGA |
| 6971 | MG3-6-CD5-target site-E2 | GTGTAGGTGACAAGGAAGGGGC |
| 6972 | MG3-6-CD5-target site-F2 | GCACCCCACAGTTCAGCCGCTG |
| 6973 | MG3-6-CD5-target site-G2 | TGGCAGACTTTTGACGCTTGAC |
| 6974 | MG3-6-CD5-target site-H2 | CCATGTGCCATCCGTCCTTGAG |
| 6975 | MG3-6-CD5-target site-A3 | GGTGAGCCTTGCCTGGAAATCT |
| 6976 | MG3-6-CD5-target site-B3 | CAGAAGACAACACCTCCAACGA |
| 6977 | MG3-6-CD5-target site-C3 | CAACTCCAGAGCCCACAGGTAA |

TABLE 11B-continued

Sites Targeted in Example 20

| SEQ ID NO: | Entity Name | Sequence |
|---|---|---|
| 6978 | MG3-6-CD5-target site-D3 | GGGCTCTGGAGTTGTGGTGGGC |
| 6979 | MG3-6-CD5-target site-E3 | TGTCGTTGGAGGTGTTGTCTTC |
| 6980 | MG3-6-CD5-target site-F3 | CTCTCTCCTCTCCTAGCTCCTC |
| 6981 | MG3-6-CD5-target site-G3 | GCCTGGGGGGTACCATCAGCTA |
| 6982 | MG3-6-CD5-target site-H3 | CCATCAGCTATGAGGCCCAGGA |
| 6983 | MG3-6-CD5-target site-A4 | CTATGAGGCCCAGGACAAGACC |
| 6984 | MG3-6-CD5-target site-B4 | GCTCCTTCTTGAAGCATCTGCC |
| 6985 | MG3-6-CD5-target site-C4 | AGAGACTGAGGCAGGCAGAGCC |
| 6986 | MG3-6-CD5-target site-D4 | ACCAGCCCTTGCCAATCCAATG |
| 6987 | MG3-6-CD5-target site-E4 | TGCCCTCCTTTGCTCAGGTAAG |
| 6988 | MG3-6-CD5-target site-F4 | GGCAAGAACTCGGCCACTTTTC |
| 6989 | MG3-6-CD5-target site-G4 | CCAGGGAGGTACAGCTTGAGTT |
| 6990 | MG3-6-CD5-target site-H4 | AGCTTGAGTTCTGGATCTTCCA |
| 6991 | MG3-6-CD5-target site-A5 | CTGGATCTTCCATTGGATTGGC |
| 6992 | MG3-6-CD5-target site-B5 | GGCTGGTGTTCCCGTGGCTCCC |
| 6993 | MG3-6-CD5-target site-C5 | GTTCCCGTGGCTCCCCTGGGTC |
| 6994 | MG3-6-CD5-target site-D5 | TGCTTCAAGAAGGAGCCACACT |
| 6995 | MG3-6-CD5-target site-E5 | AGGTTGTTGCAGAGGAAGTTCT |
| 6996 | MG3-6-CD5-target site-F5 | TGCAGAGGAAGTTCTCCAGGTC |
| 6997 | MG3-6-CD5-target site-G5 | TCTCCAGGTCCTGGGTCTTGTC |
| 6998 | MG3-6-CD5-target site-H5 | GCCTCATAGCTGATGGTACCCC |
| 6999 | MG3-6-CD5-target site-A6 | CACGCCGGCACAGTGCTGGCCG |
| 7000 | MG3-6-CD5-target site-B6 | AAGGCACCGTGGAGGTGCGCCA |
| 7001 | MG3-6-CD5-target site-C6 | GACGCTGGTGACCCAACATCCC |
| 7002 | MG3-6-CD5-target site-D6 | GGACAGAAGAGCCCCCGGGATG |
| 7003 | MG3-6-CD5-target site-E6 | TCCTGGCTGAAGAGCTGTCACA |
| 7004 | MG3-6-CD5-target site-F6 | CCCCACCAGACGGCTCTGCACC |
| 7005 | MG3-6-CD5-target site-G6 | CCCAGGCCAGGATCCAAACCCC |
| 7006 | MG3-6-CD5-target site-H6 | TTCACTAGCTTCTTGTAGGCAA |
| 7007 | MG3-6-CD5-target site-A7 | CCAGCAGCACCACCAGGAGCAC |
| 7008 | MG3-6-CD5-target site-B7 | ATGCTTGCCACCGTGCCTGCGG |
| 7009 | MG3-6-CD5-target site-C7 | ACCGTGCCTGCGGCCAGGCCTG |
| 7010 | MG3-6-CD5-target site-D7 | CCTGCGGCCAGGCCTGCGGGGT |
| 7011 | MG3-6-CD5-target site-E7 | TCCGCCAGAAGAAGCAGCGCCA |
| 7012 | MG3-6-CD5-target site-F7 | TTACTGTTTTGGTTCATTCCCG |
| 7013 | MG3-6-CD5-target site-G7 | TCCACTGGCGCTGCTTCTTCTG |
| 7014 | MG3-6-CD5-target site-H7 | AGCTGACAGGTGGGAGTTCCTG |

TABLE 11B-continued

| Sites Targeted in Example 20 | | |
|---|---|---|
| SEQ ID NO: | Entity Name | Sequence |
| 7015 | MG3-6-CD5-target site-A8 | GGCTGTATTCGTTATCCACGTG |
| 7016 | MG3-6-CD5-target site-B8 | TCGTTATCCACGTGGGAGGCTG |
| 7017 | MG3-6-CD5-target site-C8 | GGAGGCTGTGGGGTTCTCAGCA |
| 7018 | MG3-6-CD5-target site-D8 | CCTTTCTTTCCCCAGCTCTGGA |
| 7019 | MG3-6-CD5-target site-E8 | CCGACAGTGACTATGATCTGCA |
| 7020 | MG3-6-CD5-target site-F8 | GACTATGATCTGCATGGGGCTC |
| 7021 | MG3-6-CD5-target site-G8 | CTTTACAGCCTCTGAGCCCCAT |
| 7022 | MG3-6-CD5-target site-H8 | ATAGTCACTGTCGGAGGAGTTG |

Example 21—Targeted RNA Cleavage by MG3-6 and MG3-8

Figure 14:
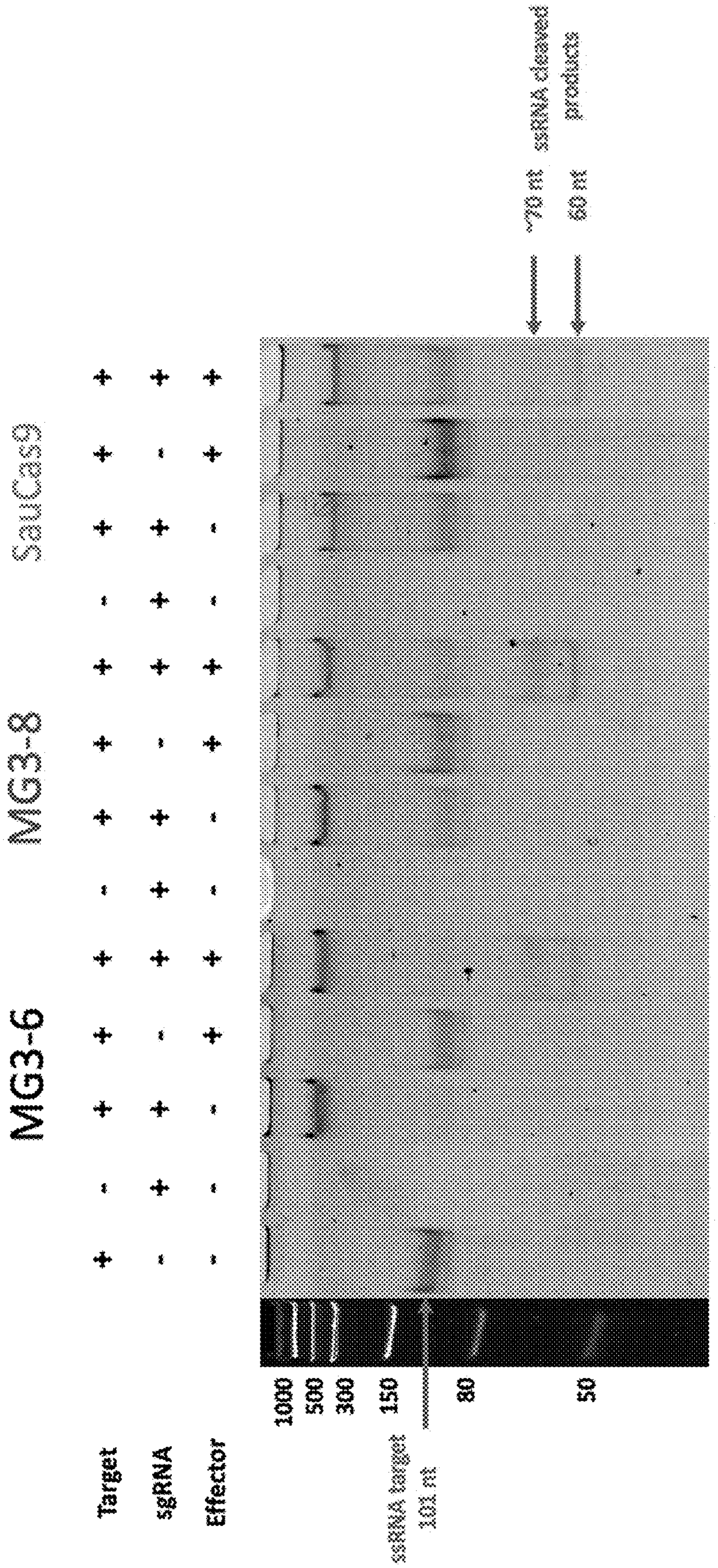
FIG. 14 depicts targeted RNA cleavage by MG3-6 and MG3-8.

A 101 ft RNA containing the spacer (GGUCAGGGCGC-GUCAGCGGGUGUUGGCGGGUGUCGGGGCUGGC-UUAAAUUUUG GACCAGUCGAGGC-UUGCGACGUGGUGGCUUUUCCAGUCGGGAA-ACCUG) with 5' adjacent sequence UUGGACCA were prepared via transcription of a T7 promoter-containing PCR product using the T7 Megascript kit (NEB) according to manufacturer instructions. The resulting RNA was purified using a Monarch RNA prep spin column (NEB) and then labeled with the 5' EndTag kit (Vector labs) using a FAM-maleimide dye per recommended instructions. The resulting RNA has one 5' label and an expected band size of 60 nt if cleaved at a single position in the spacer. For testing RNA cleavage, 2 pmol of protein and sgRNA were pre-incubated for 15 minutes before adding ssRNA target. The RNP complex was added to the labeled RNA at a 10:1 ratio (200 nM RNA: 2 μM RNP) in cleavage buffer (10 mM Tris, 100 mM NaCl, and 10 mM $MgCl_2$) and incubated at 37° C. for 1 hr. Reactions were quenched with proteinase K and resolved on a 1500 TBE Urea-PAGE gel (Bio-rad). The gel shows site-directed RNA cleavage by MG3-6 and MG3-8 as well as commercial positive control SauCas9 (NEB) (FIG. 14). The results indicated that MG3-6 and MG3-8 are capable of targeted RNA cleavage and are comparable in terms of RNA cleavage to SauCas9.

Example 22—Gene Editing Outcomes at the DNA Level for FAS

Figure 15:
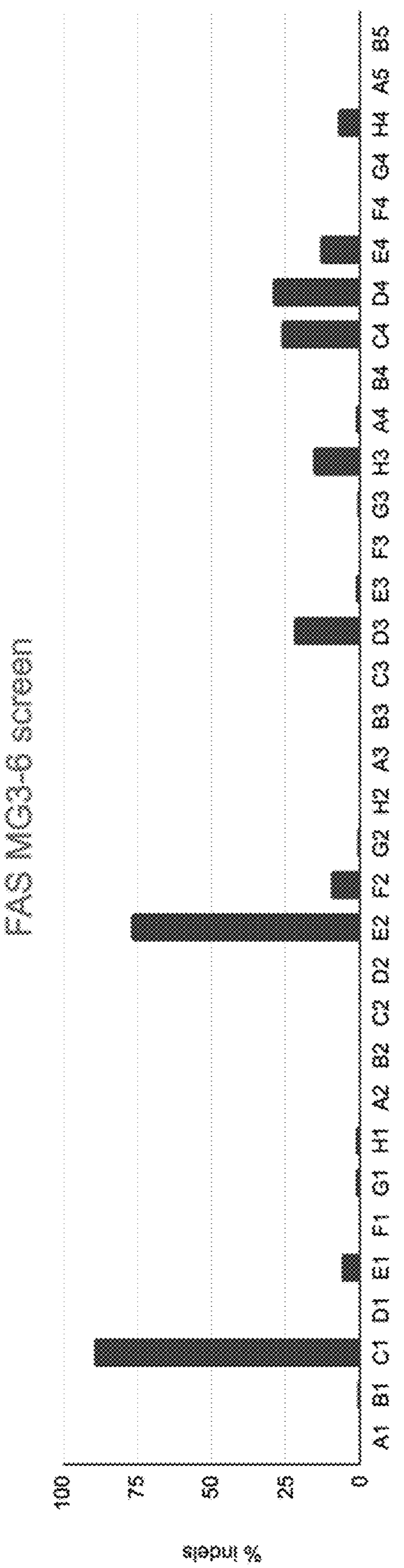
FIG. 15 depicts the gene editing outcomes at the DNA level for FAS in T cells.

Primary T cells were purified from PBMCs using a negative selection kit (Miltenyi) according to the manufacturer's recommendations. Nucleofection of MG3-6 RNPs (104 pmol protein/120 pmol guide) (SEQ ID NOs: 7023-7056) was performed into T cells (200,000) using the Lonza 4D electroporator. Cells were harvested and genomic DNA prepared three days post-transfection. PCR primers appropriate for use in NGS-based DNA sequencing were generated, optimized, and used to amplify the individual target sequences for each guide RNA (SEQ ID NOs: 7057-7090). The amplicons were sequenced on an Illumina MiSeq machine and analyzed with a proprietary Python script to measure gene editing (FIG. 15).

TABLE 12

| Guide RNAs and Sequences Targeted for Example 22 | | |
|---|---|---|
| SEQ ID NO: | NAME | SEQUENCE |
| 7023 | MG3-6-FAS-sgRNA-A1 | mC*mU*mG*rArUrGrArGrUrGrGrUrUrUrCrCrCrUrGrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 7024 | MG3-6-FAS-sgRNA-B1 | mU*mU*mA*rGrArUrGrCrUrCrArGrArGrUrGrUrGrUrGrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7025 | MG3-6-FAS-sgRNA-C1 | mG*mU*mG*rUrGrCrArCrArArGrGrCrUrGrGrCrArCrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

TABLE 12-continued

Guide RNAs and Sequences Targeted for Example 22

| SEQ ID NO: | NAME | SEQUENCE |
|---|---|---|
| 7026 | MG3-6-FAS-sgRNA-D1 | mG*mA*mG*rArCrArArGrCrCrUrArUrCrArArCrArCrCrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7027 | MG3-6-FAS-sgRNA-E1 | mA*mC*mC*rArCrCrArGrUrCrUrUrGrUrArGrGrUrGrUrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7028 | MG3-6-FAS-sgRNA-F1 | mC*mU*mU*rGrUrCrUrCrUrGrUrUrCrCrArCrCrUrUrUrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7029 | MG3-6-FAS-sgRNA-G1 | mA*mG*mU*rArGrArCrUrGrUrUrArGrUrGrCrCrArUrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mUxmU*mU |
| 7030 | MG3-6-FAS-sgRNA-H1 | mU*mU*mA*rCrArGrGrUrUrCrUrUrArCrGrUrCrUrGrUrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7031 | MG3-6-FAS-sgRNA-A2 | mC*mA*mA*rGrUrGrArCrUrGrArCrArUrCrArArCrUrCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 7032 | MG3-6-FAS-sgRNA-B2 | mA*mC*mU*rCrCrArArGrGrGrArUrUrGrGrArArUrUrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7033 | MG3-6-FAS-sgRNA-C2 | mU*mG*mA*rGrGrArArGrArCrUrGrUrUrArCrUrArCrArGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7034 | MG3-6-FAS-sgRNA-D2 | mU*mA*mC*rArGrUrUrGrArGrArCrUrCrArGrArArCrUrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUmU*mU*mU |
| 7035 | MG3-6-FAS-sgRNA-E2 | mU*mU*mU*rGrUrGrUrArArCrArUrArCrCrUrGrGrArGrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7036 | MG3-6-FAS-sgRNA-F2 | mU*mG*mG*rCrArGrArArUrUrGrGrCrCrArUrCrArUrGrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7037 | MG3-6-FAS-sgRNA-G2 | mU*mU*mG*rGrGrCrArGrGrUrGrArArArGrGrArArArGrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7038 | MG3-6-FAS-sgRNA-H2 | mC*mU*mG*rCrArCrArGrUrCrArArUrGrGrGrGrArUrGrArArGrUrUrGrArGrArArUrCrGrArArArGrArUrUrCrUrUrArArUrArAr |

TABLE 12-continued

| Guide RNAs and Sequences Targeted for Example 22 | | |
|---|---|---|
| SEQ ID NO: | NAME | SEQUENCE |
| | | GrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7039 | MG3-6-FAS-sgRNA-A3 | mU*mU*mU*rUrCrUrUrCrCrArArArUrGrCrArGrArArGrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7040 | MG3-6-FAS-sgRNA-B3 | mA*mU*mC*rUrUrCrUrGrCrArUrUrGrGrArArGrArArArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7041 | MG3-6-FAS-sgRNA-C3 | mU*mA*mG*rArArGrUrGrGrArArArUrArArArCrUrGrCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7042 | MG3-6-FAS-sgRNA-D3 | mA*mA*mG*rArCrUrArArArCrUrUrArCrUrUrGrGrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrUxmU*mU*mU |
| 7043 | MG3-6-FAS-sgRNA-E3 | mG*mU*mU*rUrArCrArUrCrUrGrCrArCrUrUrGrGrUrArUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7044 | MG3-6-FAS-sgRNA-F3 | mA*mA*mG*rArArGrArCrArArArGrCrCrArCrCrCrCrArArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7045 | MG3-6-FAS-sgRNA-G3 | mA*mC*mA*rArArGrCrCrArCrCrCrCrArArGrUrUrArGrArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7046 | MG3-6-FAS-sgRNA-H3 | mC*mC*mC*rCrArArGrUrUrArGrArUrCrUrGrGrArUrCrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7047 | MG3-6-FAS-sgRNA-A4 | mC*mA*mG*rArArArGrCrArCrArGrArArArGrGrArArArArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7048 | MG3-6-FAS-sgRNA-B4 | mA*mA*mU*rArCrCrUrArCrArGrGrArUrUrUrArArArGrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7049 | MG3-6-FAS-sgRNA-C4 | mC*mA*mG*rUrGrGrCrArArUrArArArUrUrUrArUrCrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |

TABLE 12-continued

Guide RNAs and Sequences Targeted for Example 22

| SEQ ID NO: | NAME | SEQUENCE |
|---|---|---|
| 7050 | MG3-6-FAS-sgRNA-D4 | mA*mG*mU*rCrArUrGrArCrArCrUrArArGrUrCrArArGrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUmUmU*mU |
| 7051 | MG3-6-FAS-sgRNA-E4 | mG*mU*mG*rUrCrArArUrGrArArGrCrCrArArArArUrArGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7052 | MG3-6-FAS-sgRNA-F4 | mA*mG*mA*rArGrCrGrUrArUrGrArCrArCrArUrUrGrArUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mUxmU*mU |
| 7053 | MG3-6-FAS-sgRNA-G4 | mU*mU*mU*rGrUrArCrUrCrUrUrGrCrArGrArGrArArArArUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7054 | MG3-6-FAS-sgRNA-H4 | mG*mU*mU*rUrUrUrCrArCrUrCrUrArGrArCrCrArArGrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7055 | MG3-6-FAS-sgRNA-A5 | mU*mG*mA*rArUrUrUrUrCrUrCrUrGrCrArArGrArGrUrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7056 | MG3-6-FAS-sgRNA-B5 | mA*mG*mA*rGrUrArCrArArArGrArUrUrGrGrCrUrUrUrUrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 7057 | MG3-6-FAS-target site-A1 | CTGATGAGTGGTTTCCCTGAGC |
| 7058 | MG3-6-FAS-target site-B1 | TTAGATGCTCAGAGTGTGTGCA |
| 7059 | MG3-6-FAS-target site-C1 | GTGTGCACAAGGCTGGCACGCC |
| 7060 | MG3-6-FAS-target site-D1 | GAGACAAGCCTATCAACACCTA |
| 7061 | MG3-6-FAS-target site-E1 | ACCACCAGTCTTGTAGGTGTTG |
| 7062 | MG3-6-FAS-target site-F1 | CTTGTCTCTGTTCCACCTTTCA |
| 7063 | MG3-6-FAS-target site-G1 | AGTAGACTGTTAGTGCCATGAG |
| 7064 | MG3-6-FAS-target site-H1 | TTACAGGTTCTTACGTCTGTTG |
| 7065 | MG3-6-FAS-target site-A2 | CAAGTGACTGACATCAACTCCA |
| 7066 | MG3-6-FAS-target site-B2 | ACTCCAAGGGATTGGAATTGAG |
| 7067 | MG3-6-FAS-target site-C2 | TGAGGAAGACTGTTACTACAGT |

TABLE 12-continued

| Guide RNAs and Sequences Targeted for Example 22 | | |
|---|---|---|
| SEQ ID NO: | NAME | SEQUENCE |
| 7068 | MG3-6-FAS-target site-D2 | TACAGTTGAGACTCAGAACTTG |
| 7069 | MG3-6-FAS-target site-E2 | TTTGTGTAACATACCTGGAGGA |
| 7070 | MG3-6-FAS-target site-F2 | TGGCAGAATTGGCCATCATGAT |
| 7071 | MG3-6-FAS-target site-G2 | TTGGGCAGGTGAAAGGAAAGCT |
| 7072 | MG3-6-FAS-target site-H2 | CTGCACAGTCAATGGGGATGAA |
| 7073 | MG3-6-FAS-target site-A3 | TTTTCTTCCAAATGCAGAAGAT |
| 7074 | MG3-6-FAS-target site-B3 | ATCTTCTGCATTTGGAAGAAAA |
| 7075 | MG3-6-FAS-target site-C3 | TAGAAGTGGAAATAAACTGCAC |
| 7076 | MG3-6-FAS-target site-D3 | AAGACTAAAACTTACTTGGTGC |
| 7077 | MG3-6-FAS-target site-E3 | GTTTACATCTGCACTTGGTATT |
| 7078 | MG3-6-FAS-target site-F3 | AAGAAGACAAAGCCACCCCAAG |
| 7079 | MG3-6-FAS-target site-G3 | ACAAAGCCACCCCAAGTTAGAT |
| 7080 | MG3-6-FAS-target site-H3 | CCCCAAGTTAGATCTGGATCCT |
| 7081 | MG3-6-FAS-target site-A4 | CAGAAAGCACAGAAAGGAAAAC |
| 7082 | MG3-6-FAS-target site-B4 | AATACCTACAGGATTTAAAGTT |
| 7083 | MG3-6-FAS-target site-C4 | CAGTGGCAATAAATTTATCTGG |
| 7084 | MG3-6-FAS-target site-D4 | AGTCATGACACTAAGTCAAGTT |
| 7085 | MG3-6-FAS-target site-E4 | GTGTCAATGAAGCCAAAATAGA |
| 7086 | MG3-6-FAS-target site-F4 | AGAAGCGTATGACACATTGATT |
| 7087 | MG3-6-FAS-target site-G4 | TTTGTACTCTTGCAGAGAAAAT |
| 7088 | MG3-6-FAS-target site-H4 | GTTTTTCACTCTAGACCAAGCT |
| 7089 | MG3-6-FAS-target site-A5 | TGAATTTTCTCTGCAAGAGTAC |
| 7090 | MG3-6-FAS-target site-B5 | AGAGTACAAAGATTGGCTTTTT |

r = native ribose base, m = 2'-O methyl modified base, F = 2' Fluro modified base, * = phosphorothioate bond

Example 23—Gene Editing Outcomes at the DNA Level for PD-1

Figure 16:
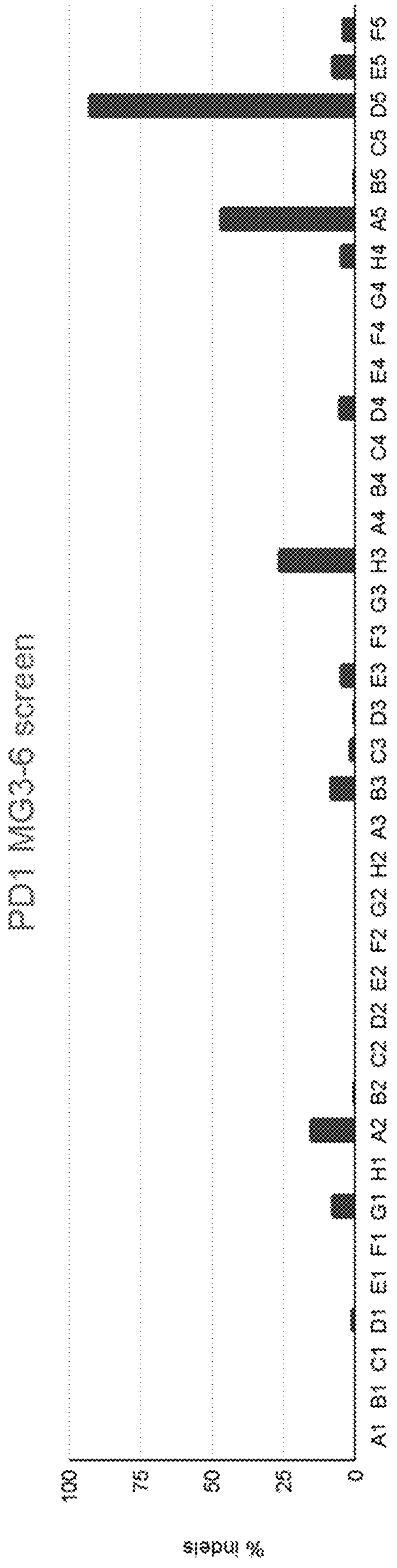
FIG. 16 depicts the gene editing outcomes at the DNA level for PD-1 in T cells.

Primary T cells were purified from PBMCs using a negative selection kit (Miltenyi) according to the manufacturer's recommendations. Nucleofection of MG3-6 RNPs (104 pmol protein/120 pmol guide) (SEQ ID NOs: 7091-7128) was performed into T cells (200,000) using the Lonza 4D electroporator. Cells were harvested and genomic DNA prepared three days post-transfection. PCR primers appropriate for use in NGS-based DNA sequencing were generated, optimized, and used to amplify the individual target sequences for each guide RNA (SEQ ID NOs: 7129-7166). The amplicons were sequenced on an Illumina MiSeq machine and analyzed with a proprietary Python script to measure gene editing (FIG. 16).

TABLE 13

Guide RNAs and Sequences Targeted for Example 23

| SEQ ID NO: | NAME | SEQUENCE |
|---|---|---|
| 7091 | MG3-6-PD-1-sgRNA-A1 | mG*mG*mU*rGrGrCrCrArArGrGrArArGrCrCrGrGrUrCrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7092 | MG3-6-PD-1-sgRNA-B1 | mG*mG*mG*rCrCrArArGrArGrCrArGrUrGrUrCrCrArUrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 7093 | MG3-6-PD-1-sgRNA-C1 | mG*mG*mC*rCrCrUrCrGrGrArGrUrGrCrCrCrArGrCrCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7094 | MG3-6-PD-1-sgRNA-D1 | mG*mG*mC*rCrUrCrArGrUrGrGrCrUrGrGrGrCrArCrUrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7095 | MG3-6-PD-1-sgRNA-E1 | mG*mG*mG*rCrArCrCrUrCrArUrCrCrCrCrCrGrCrCrCrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7096 | MG3-6-PD-1-sgRNA-F1 | mC*mU*mG*rCrUrCrArGrGrGrArCrArCrArGrGrGrCrArCrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7097 | MG3-6-PD-1-sgRNA-G1 | mG*mG*mA*rCrArCrArGrGrGrCrArCrGrGrGrGrGrGrCrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7098 | MG3-6-PD-1-sgRNA-H1 | mA*mG*mC*rUrGrGrArUrUrUrCrCrArGrUrGrGrCrGrArGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7099 | MG3-6-PD-1-sgRNA-A2 | mG*mU*mU*rCrUrCrUrGrUrGrGrArCrUrArUrGrGrGrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7100 | MG3-6-PD-1-sgRNA-B2 | mC*mU*mC*rArGrCrCrGrUrGrCrCrUrGrUrGrUrUrCrUrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7101 | MG3-6-PD-1-sgRNA-C2 | mA*mC*mA*rGrArGrArArCrArCrArGrGrCrArCrGrGrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrA |

TABLE 13-continued

| Guide RNAs and Sequences Targeted for Example 23 | | |
|---|---|---|
| SEQ ID NO: | NAME | SEQUENCE |
| | | rCrCrGrUrCrCrGrUrUrUrCrCrArArUrArGrGrArGrCrGrGrGr<br>CrGrGrUrArUrGrU*mU*mU*mU |
| 7102 | MG3-6-PD-1-sgRNA-D2 | mG*mG*mG*rUrCrCrUrGrGrCrCrGrUrCrArUrCrUrGrCrUrCrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mU*mU |
| 7103 | MG3-6-PD-1-sgRNA-E2 | mC*mG*mG*rCrCrCrGrGrGrArGrCrArGrArUrGrArCrGrGrCrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mUxmU |
| 7104 | MG3-6-PD-1-sgRNA-F2 | mG*mG*mG*rArGrCrArGrArUrGrArCrGrGrCrCrArGrGrArCrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mU*mU |
| 7105 | MG3-6-PD-1-sgRNA-G2 | mU*mG*mG*rGrCrArGrCrCrUrGrGrUrGrCrUrGrCrUrArGrUrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mU*mU |
| 7106 | MG3-6-PD-1-sgRNA-H2 | mG*mC*mC*rArGrGrArCrCrCrArGrArCrUrArGrCrArGrCrArG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mU*mU |
| 7107 | MG3-6-PD-1-sgRNA-A3 | mA*mC*mU*rArGrCrArGrCrArCrCrArGrGrCrUrGrCrCrCrArGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrCrCrArArUrArGrGrArGrCrGrGrGr<br>CrGrGrUrArUrGrU*mU*mU*mU |
| 7108 | MG3-6-PD-1-sgRNA-B3 | mG*mG*mC*rCrGrCrCrCrArCrGrArCrArCrCrArArCrCrArCrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrCrCrArArUrArGrGrArGrCrGrGrGr<br>CrGrGrUrArUrGrU*mU*mU*mU |
| 7109 | MG3-6-PD-1-sgRNA-C3 | mA*mA*mC*rUrGrGrCrCrGrGrCrUrGrGrCrCrUrGrGrGrUrGrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mU*mU |
| 7110 | MG3-6-PD-1-sgRNA-D3 | mA*mC*mA*rGrCrCrCrArCrCrCrCrArGrCrCrCrCrUrCrArCrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrCrCrArArUrArGrGrArGrCrGrGrGr<br>CrGrGrUrArUrGrU*mU*mU*mU |
| 7111 | MG3-6-PD-1-sgRNA-E3 | mC*mU*mG*rGrCrCrUrGrGrGrUrGrArGrGrGrGrCrUrGrGrGrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrCrCrArArUrArGrGrArGrCrGrGrGr<br>CrGrGrUrArUrGrU*mU*mU*mU |
| 7112 | MG3-6-PD-1-sgRNA-F3 | mC*mC*mU*rGrUrCrArCrCrCrUrGrArGrCrUrCrUrGrCrCrCrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrCrCrArArUrArGrGrArGrCrGrGrGr<br>CrGrGrUrArUrGrU*mU*mU*mU |
| 7113 | MG3-6-PD-1-sgRNA-G3 | mG*mG*mC*rUrCrUrCrUrUrUrGrArUrCrUrGrCrGrCrCrUrUrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrCrCrArArUrArGrGrArGrCrGrGrGr<br>CrGrGrUrArUrGrU*mU*mU*mU |

TABLE 13-continued

Guide RNAs and Sequences Targeted for Example 23

| SEQ ID NO: | NAME | SEQUENCE |
|---|---|---|
| 7114 | MG3-6-PD-1-sgRNA-H3 | mC*mC*mA*rUrCrUrCrCrCrUrGrGrCrCrCrCrCrArArGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7115 | MG3-6-PD-1-sgRNA-A4 | mA*mU*mG*rArCrArGrCrGrGrCrArCrCrUrArCrCrUrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mUxmU*mU |
| 7116 | MG3-6-PD-1-sgRNA-B4 | mG*mG*mU*rArGrGrUrGrCrCrGrCrUrGrUrCrArUrUrGrCrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7117 | MG3-6-PD-1-sgRNA-C4 | mG*mU*mG*rArCrUrUrCrCrArCrArUrGrArGrCrGrUrGrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7118 | MG3-6-PD-1-sgRNA-D4 | mG*mA*mC*rArCrGrGrArArGrCrGrGrCrArGrUrCrCrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUmU*mU*mU |
| 7119 | MG3-6-PD-1-sgRNA-E4 | mC*mG*mA*rGrGrArCrCrGrCrArGrCrCrArGrCrCrCrGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7120 | MG3-6-PD-1-sgRNA-F4 | mG*mG*mA*rCrArArGrCrUrGrGrCrCrGrCrCrUrUrCrCrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7121 | MG3-6-PD-1-sgRNA-G4 | mG*mC*mC*rArGrCrUrUrGrUrCrCrGrUrCrUrGrGrUrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7122 | MG3-6-PD-1-sgRNA-H4 | mU*mG*mU*rCrCrCrCrUrUrCrGrGrUrCrArCrCrArCrGrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7123 | MG3-6-PD-1-sgRNA-A5 | mA*mG*mC*rArGrGrGrCrUrGrGrGrGrArGrArArGrGrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7124 | MG3-6-PD-1-sgRNA-B5 | mU*mG*mG*rGrGrArGrArArGrGrUrGrGrGrGrGrGrUrUrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 7125 | MG3-6-PD-1-sgRNA-C5 | mC*mU*mC*rCrArUrCrUrCrUrCrArGrArCrUrCrCrCrCrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |

TABLE 13-continued

Guide RNAs and Sequences Targeted for Example 23

| SEQ ID NO: | NAME | SEQUENCE |
|---|---|---|
| 7126 | MG3-6-PD-1-sgRNA-D5 | mG*mC*mC*rArGrGrArUrGrGrUrUrCrUrUrArGrGrUrArGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7127 | MG3-6-PD-1-sgRNA-E5 | mA*mG*mU*rCrGrUrCrUrGrGrGrCrGrGrUrGrCrUrArCrArArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7128 | MG3-6-PD-1-sgRNA-F5 | mA*mG*mA*rCrGrArCrUrGrGrCrCrArGrGrGrCrGrCrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7129 | MG3-6-PD-1-target site-A1 | GGTGGCCAAGGAAGCCGGTCAG |
| 7130 | MG3-6-PD-1-target site-B1 | GGGCCAAGAGCAGTGTCCATCC |
| 7131 | MG3-6-PD-1-target site-C1 | GGCCCTCGGAGTGCCCAGCCAC |
| 7132 | MG3-6-PD-1-target site-D1 | GGCCTCAGTGGCTGGGCACTCC |
| 7133 | MG3-6-PD-1-target site-E1 | GGGCACCTCATCCCCCGCCCGC |
| 7134 | MG3-6-PD-1-target site-F1 | GGACACAGGGCACGGGGGGCTC |
| 7135 | MG3-6-PD-1-target site-G1 | GGACACAGGGCACGGGGGGCTC |
| 7136 | MG3-6-PD-1-target site-H1 | AGCTGGATTTCCAGTGGCGAGA |
| 7137 | MG3-6-PD-1-target site-A2 | GTTCTCTGTGGACTATGGGGAG |
| 7138 | MG3-6-PD-1-target site-B2 | CTCAGCCGTGCCTGTGTTCTCT |
| 7139 | MG3-6-PD-1-target site-C2 | ACAGAGAACACAGGCACGGCTG |
| 7140 | MG3-6-PD-1-target site-D2 | GGGTCCTGGCCGTCATCTGCTC |
| 7141 | MG3-6-PD-1-target site-E2 | CGGCCCGGGAGCAGATGACGGC |
| 7142 | MG3-6-PD-1-target site-F2 | GGGAGCAGATGACGGCCAGGAC |
| 7143 | MG3-6-PD-1-target site-G2 | TGGGCAGCCTGGTGCTGCTAGT |
| 7144 | MG3-6-PD-1-target site-H2 | GCCAGGACCCAGACTAGCAGCA |
| 7145 | MG3-6-PD-1-target site-A3 | ACTAGCAGCACCAGGCTGCCCA |
| 7146 | MG3-6-PD-1-target site-B3 | GGCCGCCCACGACACCAACCAC |
| 7147 | MG3-6-PD-1-target site-C3 | AACTGGCCGGCTGGCCTGGGTG |

TABLE 13-continued

Guide RNAs and Sequences Targeted for Example 23

| SEQ ID NO: | NAME | SEQUENCE |
|---|---|---|
| 7148 | MG3-6-PD-1-target site-D3 | ACAGCCCACCCCAGCCCCTCAC |
| 7149 | MG3-6-PD-1-target site-E3 | CTGGCCTGGGTGAGGGGCTGGG |
| 7150 | MG3-6-PD-1-target site-F3 | CCTGTCACCCTGAGCTCTGCCC |
| 7151 | MG3-6-PD-1-target site-G3 | GGCTCTCTTTGATCTGCGCCTT |
| 7152 | MG3-6-PD-1-target site-H3 | CCATCTCCCTGGCCCCCAAGGC |
| 7153 | MG3-6-PD-1-target site-A4 | ATGACAGCGGCACCTACCTCTG |
| 7154 | MG3-6-PD-1-target site-B4 | GGTAGGTGCCGCTGTCATTGCG |
| 7155 | MG3-6-PD-1-target site-C4 | GTGACTTCCACATGAGCGTGGT |
| 7156 | MG3-6-PD-1-target site-D4 | GACACGGAAGCGGCAGTCCTGG |
| 7157 | MG3-6-PD-1-target site-E4 | CGAGGACCGCAGCCAGCCCGGC |
| 7158 | MG3-6-PD-1-target site-F4 | GGACAAGCTGGCCGCCTTCCCC |
| 7159 | MG3-6-PD-1-target site-G4 | GCCAGCTTGTCCGTCTGGTTGC |
| 7160 | MG3-6-PD-1-target site-H4 | TGTCCCCTTCGGTCACCACGAG |
| 7161 | MG3-6-PD-1-target site-A5 | AGCAGGGCTGGGGAGAAGGTGG |
| 7162 | MG3-6-PD-1-target site-B5 | TGGGGAGAAGGTGGGGGGGTTC |
| 7163 | MG3-6-PD-1-target site-C5 | CTCCATCTCTCAGACTCCCCAG |
| 7164 | MG3-6-PD-1-target site-D5 | GCCAGGATGGTTCTTAGGTAGG |
| 7165 | MG3-6-PD-1-target site-E5 | AGTCGTCTGGGCGGTGCTACAA |
| 7166 | MG3-6-PD-1-target site-F5 | AGACGACTGGCCAGGGCGCCTG |

r = native ribose base, m = 2'-O methyl modified base, F = 2' Fluro modified base, * = phosphorothioate bond

Example 24—Gene Editing Outcomes at the DNA Level for hRosa26

Figure 17:
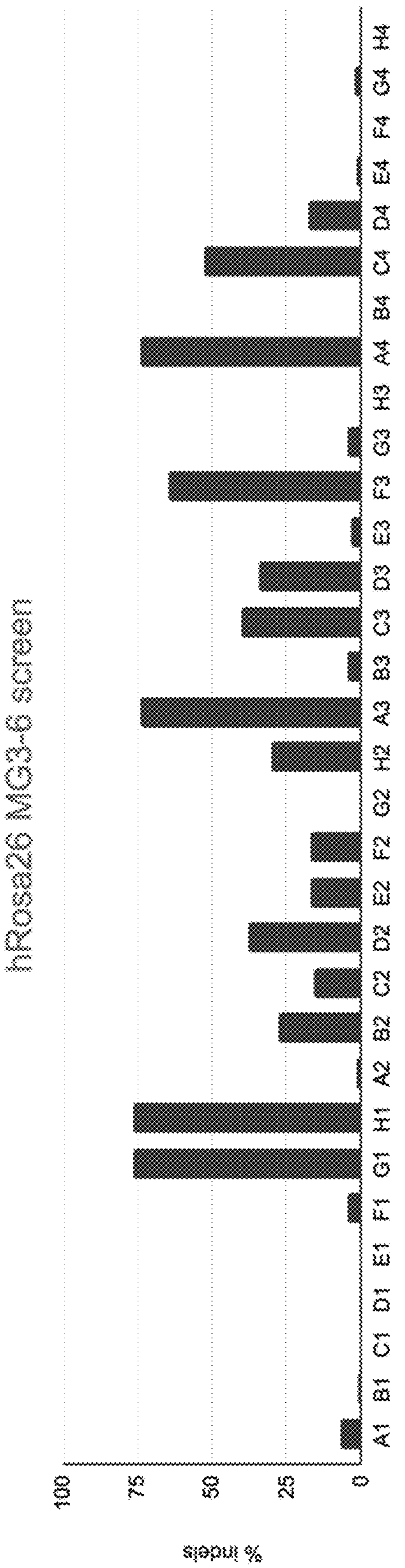
FIG. 17 depicts the gene editing outcomes at the DNA level for hRosa26 in T cells.

Primary T cells were purified from PBMCs using a negative selection kit (Miltenyi) according to the manufacturer's recommendations. Nucleofection of MG3-6 RNPs (104 pmol protein/120 pmol guide) (SEQ ID NOs: 7167-7198) was performed into T cells (200,000) using the Lonza 4D electroporator. Cells were harvested and genomic DNA prepared three days post-transfection. PCR primers appropriate for use in NGS-based DNA sequencing were generated, optimized, and used to amplify the individual target sequences for each guide RNA (SEQ ID NOs: 7199-7230). The amplicons were sequenced on an Illumina MiSeq machine and analyzed with a proprietary Python script to measure gene editing (FIG. 17).

TABLE 14

Guide RNAs and Sequences Targeted for Example 24

| SEQ ID NO: | NAME | SEQUENCE |
|---|---|---|
| 7167 | MG3-6-hRosa26-sgRNA-A1 | mA*mU*mC*rUrGrUrCrUrGrGrUrUrUrCrGrCrGrArGrArCrArG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrUrCrCrArArUrArGrGrArGrCrGrGrGr<br>CrGrGrUrArUrGrU*mU*mU*mU |
| 7168 | MG3-6-hRosa26-sgRNA-B1 | mU*mU*mU*rCrGrCrGrArGrArCrArCrCrArGrGrCrUrArCrCrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrUrCrCrArArUrArGrGrArGrCrGrGrGr<br>CrGrGrUrArUrGrU*mU*mU*mU |
| 7169 | MG3-6-hRosa26-sgRNA-C1 | mA*mG*mC*rArArGrUrArCrArArCrArArArUrGrGrArArArArGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrUrCrCrArArUrArGrGrArGrCrGrGrGr<br>CrGrGrUrArUrGrU*mU*mU*mU |
| 7170 | MG3-6-hRosa26-sgRNA-D1 | mG*mC*mA*rArArArGrCrUrArArArArUrUrUrUrUrCrUrArUrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrUrCrCrArArUrArGrGrArGrCrGrGrGr<br>CrGrGrUrArUrGrU*mU*mU*mU |
| 7171 | MG3-6-hRosa26-sgRNA-E1 | mU*mG*mC*rUrArCrArCrUrUrUrGrGrUrGrGrUrGrCrArGrCrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrUrCrCrArArUrArGrGrArGrCrGrGrGr<br>CrGrGrUrArUrGrU*mU*mU*mU |
| 7172 | MG3-6-hRosa26-sgRNA-F1 | mA*mC*mU*rCrCrCrCrUrGrCrArGrGrGrCrArArCrGrCrCrCrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrUrCrCrArArUrArGrGrArGrCrGrGrGr<br>CrGrGrUrArUrGrU*mU*mU*mU |
| 7173 | MG3-6-hRosa26-sgRNA-G1 | mC*mG*mA*rCrUrCrGrArCrArUrGrGrArGrGrCrGrArUrGrArG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrUrCrCrArArUrArGrGrArGrCrGrGrGr<br>CrGrGrUrArUrGrU*mU*mU*mU |
| 7174 | MG3-6-hRosa26-sgRNA-H1 | mA*mU*mC*rArCrGrCrGrArGrGrArGrGrArArArGrGrArGrGrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrUrCrCrArArUrArGrGrArGrCrGrGrGr<br>CrGrGrUrArUrGrU*mU*mU*mU |
| 7175 | MG3-6-hRosa26-sgRNA-A2 | mA*mG*mG*rArArArGrGrArGrGrGrArGrGrGrCrUrUrCrUrUrG<br>rUrUrGrArGrArArUrCrGrArArArGrArUrUrCrUrUrArArUrArAr<br>GrGrCrArUrCrCrUrUrCrCrGrArUrGrCrUrGrArCrUrUrCrUrCrA<br>rCrCrGrUrCrCrGrUrUrUrUrCrCrArArUrArGrGrArGrCrGrGrGr<br>CrGrGrUrArUrGrU*mU*mU*mU |
| 7176 | MG3-6-hRosa26-sgRNA-B2 | mA*mC*mC*rUrCrCrUrCrCrArCrCrGrCrArGrCrUrCrCrCrUrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr<br>CrCrGrUrCrCrGrUrUrUrUrCrCrArArUrArGrGrArGrCrGrGrGr<br>CrGrGrUrArUrGrUmUmU*mU |
| 7177 | MG3-6-hRosa26-sgRNA-C2 | mG*mC*mG*rCrCrUrCrCrCrArCrCrCrArCrArArArCrCrArGrGr<br>UrUrGrArGrArArUrCrGrArArArGrArUrUrCrUrUrArArUrArArG<br>rGrCrArUrCrCrUrUrCrCrGrArUrGrCrUrGrArCrUrUrCrUrCrAr |

TABLE 14-continued

| Guide RNAs and Sequences Targeted for Example 24 | | |
|---|---|---|
| SEQ ID NO: | NAME | SEQUENCE |
| | | CrCrGrUrCrCrGrUrUrUrCrCrArArUrArGrGrArGrCrGrGrCrGrGrUrArUrGrUxmU*mU*mU |
| 7178 | MG3-6-hRosa26-sgRNA-D2 | mC*mC*mC*rArCrCrCrCrArCrGrArGrUrGrCrCrUrGrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7179 | MG3-6-hRosa26-sgRNA-E2 | mC*mU*mC*rGrUrGrGrGrGrUrGrGrGrGrArGrGrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7180 | MG3-6-hRosa26-sgRNA-F2 | mG*mC*mU*rGrCrGrGrUrGrGrArGrGrArGrGrUrGrGrArGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7181 | MG3-6-hRosa26-sgRNA-G2 | mU*mC*mU*rCrUrGrCrUrGrCrCrUrCrCrCrGrUrCrUrUrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7182 | MG3-6-hRosa26-sgRNA-H2 | mC*mU*mC*rCrCrGrUrCrUrUrGrUrArArGrGrArCrCrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7183 | MG3-6-hRosa26-sgRNA-A3 | mC*mG*mA*rGrUrCrGrCrUrUrCrUrCrGrArUrUrArUrGrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7184 | MG3-6-hRosa26-sgRNA-B3 | mA*mU*mU*rArUrGrGrGrCrGrGrGrArUrUrCrUrUrUrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mUxmU*mU |
| 7185 | MG3-6-hRosa26-sgRNA-C3 | mG*mG*mG*rArUrUrCrUrUrUrUrGrCrCrUrArGrGrCrUrUrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrUxmUxmU*mU |
| 7186 | MG3-6-hRosa26-sgRNA-D3 | mC*mC*mU*rGrCrArGrGrGrArGrUrGrArGrCrArGrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7187 | MG3-6-hRosa26-sgRNA-E3 | mA*mC*mU*rCrCrGrArUrUrArGrUrUrUrArUrCrUrUrCrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7188 | MG3-6-hRosa26-sgRNA-F3 | mU*mC*mC*rCrArCrGrGrArCrUrArGrArGrUrUrGrGrUrGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 7189 | MG3-6-hRosa26-sgRNA-G3 | mA*mA*mA*rUrGrGrArGrCrUrUrArGrUrCrArUrUrCrArCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |

TABLE 14-continued

| Guide RNAs and Sequences Targeted for Example 24 | | |
|---|---|---|
| SEQ ID NO: | NAME | SEQUENCE |
| 7190 | MG3-6-hRosa26-sgRNA-H3 | mA*mC*mC*rUrGrGrGrCrUrGrArUrUrUrArUrGrCrArArG rUrUrGrArGrArArUrCrGrArArArGrArUrUrCrUrUrArArUrArAr GrGrCrArUrCrCrUrUrCrCrGrArUrGrCrUrGrArCrUrUrCrUrCrA rCrCrGrUrCrCrGrUrUrUrCrCrArArUrArGrGrArGrCrGrGrGr CrGrGrUrArUrGrU*mU*mU*mU |
| 7191 | MG3-6-hRosa26-sgRNA-A4 | mG*mC*mU*rGrArUrUrUrArUrGrCrArArCrGrArGrArCrUrGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7192 | MG3-6-hRosa26-sgRNA-B4 | mA*mU*mC*rArCrCrUrGrArGrUrUrUrArUrArCrCrArUrUrGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7193 | MG3-6-hRosa26-sgRNA-C4 | mG*mC*mU*rGrCrArCrCrArCrCrArArArGrUrGrUrArGrCrArGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7194 | MG3-6-hRosa26-sgRNA-D4 | mU*mU*mC*rCrCrUrCrCrCrUrCrArCrCrCrUrCrUrCrUrCrCrGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7195 | MG3-6-hRosa26-sgRNA-E4 | mG*mC*mC*rUrGrGrUrGrUrCrUrCrGrCrGrArArArCrCrArGrG rUrUrGrArGrArArUrCrGrArArArGrArUrUrCrUrUrArArUrArAr GrGrCrArUrCrCrUrUrCrCrGrArUrGrCrUrGrArCrUrUrCrUrCrA rCrCrGrUrCrCrGrUrUrUrCrCrArArUrArGrGrArGrCrGrGrGr CrGrGrUrArUrGrU*mU*mU*mU |
| 7196 | MG3-6-hRosa26-sgRNA-F4 | mA*mC*mA*rGrArUrUrGrGrUrUrCrCrArCrCrArCrArArArUrGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7197 | MG3-6-hRosa26-sgRNA-G4 | mC*mA*mC*rCrArCrArArArUrUrArArGrGrCrUrUrGrArGrCrGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7198 | MG3-6-hRosa26-sgRNA-H4 | mC*mA*mU*rUrUrUrArUrCrCrUrUrUrUrUrCrCrUrUrArGrCrGr UrUrGrArGrArArUrCrGrArArArGrArUrUrCrUrUrArArUrArArG rGrCrArUrCrCrUrUrCrCrGrArUrGrCrUrGrArCrUrUrCrUrCrAr CrCrGrUrCrCrGrUrUrUrCrCrArArUrArGrGrArGrCrGrGrGr CrGrGrUrArUrGrU*mU*mU*mU |
| 7199 | MG3-6-hRosa26-target site-A1 | ATCTGTCTGGTTTCGCGAGACA |
| 7200 | MG3-6-hRosa26-target site-B1 | TTTCGCGAGACACCAGGCTACC |
| 7201 | MG3-6-hRosa26-target site-C1 | AGCAAGTACAACAAATGGAAAA |
| 7202 | MG3-6-hRosa26-target site-D1 | GCAAAAGCTAAAATTTTTCTAT |
| 7203 | MG3-6-hRosa26-target site-E1 | TGCTACACTTTGGTGGTGCAGC |

TABLE 14-continued

Guide RNAs and Sequences Targeted for Example 24

| SEQ ID NO: | NAME | SEQUENCE |
|---|---|---|
| 7204 | MG3-6-hRosa26-target site-F1 | ACTCCCCTGCAGGGCAACGCCC |
| 7205 | MG3-6-hRosa26-target site-G1 | CGACTCGACATGGAGGCGATGA |
| 7206 | MG3-6-hRosa26-target site-H1 | ATCACGCGAGGAGGAAAGGAGG |
| 7207 | MG3-6-hRosa26-target site-A2 | AGGAAAGGAGGGAGGGCTTCTT |
| 7208 | MG3-6-hRosa26-target site-B2 | ACCTCCTCCACCGCAGCTCCCT |
| 7209 | MG3-6-hRosa26-target site-C2 | GCGCCTCCCACCCACAAACCAG |
| 7210 | MG3-6-hRosa26-target site-D2 | CCCACCCCCACGAGTGCCTGTA |
| 7211 | MG3-6-hRosa26-target site-E2 | CTCGTGGGGGTGGGGGAGGAGC |
| 7212 | MG3-6-hRosa26-target site-F2 | GCTGCGGTGGAGGAGGTGGAGA |
| 7213 | MG3-6-hRosa26-target site-G2 | TCTCTGCTGCCTCCCGTCTTGT |
| 7214 | MG3-6-hRosa26-target site-H2 | CTCCCGTCTTGTAAGGACCGCC |
| 7215 | MG3-6-hRosa26-target site-A3 | CGAGTCGCTTCTCGATTATGGG |
| 7216 | MG3-6-hRosa26-target site-B3 | ATTATGGGGGGATTCTTTTGC |
| 7217 | MG3-6-hRosa26-target site-C3 | GGGATTCTTTTGCCTAGGCTTA |
| 7218 | MG3-6-hRosa26-target site-D3 | CCTGCAGGGGAGTGAGCAGCTG |
| 7219 | MG3-6-hRosa26-target site-E3 | ACTCCGATTAGTTTATCTTCCC |
| 7220 | MG3-6-hRosa26-target site-F3 | TCCCACGGACTAGAGTTGGTGT |
| 7221 | MG3-6-hRosa26-target site-G3 | AAATGGAGCTTAGTCATTCACC |
| 7222 | MG3-6-hRosa26-target site-H3 | ACCTGGGGCTGATTTTATGCAA |
| 7223 | MG3-6-hRosa26-target site-A4 | GCTGATTTTATGCAACGAGACT |
| 7224 | MG3-6-hRosa26-target site-B4 | ATCACCTGAGTTTTATACCATT |
| 7225 | MG3-6-hRosa26-target site-C4 | GCTGCACCACCAAAGTGTAGCA |
| 7226 | MG3-6-hRosa26-target site-D4 | TTCCCTCCCTCACCCTCTCTCC |
| 7227 | MG3-6-hRosa26-target site-E4 | GCCTGGTGTCTCGCGAAACCAG |
| 7228 | MG3-6-hRosa26-target site-F4 | ACAGATTGGTTCCACCACAAAT |

TABLE 14-continued

Guide RNAs and Sequences Targeted for Example 24

| SEQ ID NO: | NAME | SEQUENCE |
|---|---|---|
| 7229 | MG3-6-hRosa26-target site-G4 | CACCACAAATTAAGGCTTGAGC |
| 7230 | MG3-6-hRosa26-target site-H4 | CATTTTATCCTTTTTCCTTAGC |

r = native ribose base, m = 2'-O methyl modified base, F = 2' Fluro modified base, * = phosphorothioate bond

Figure 18:
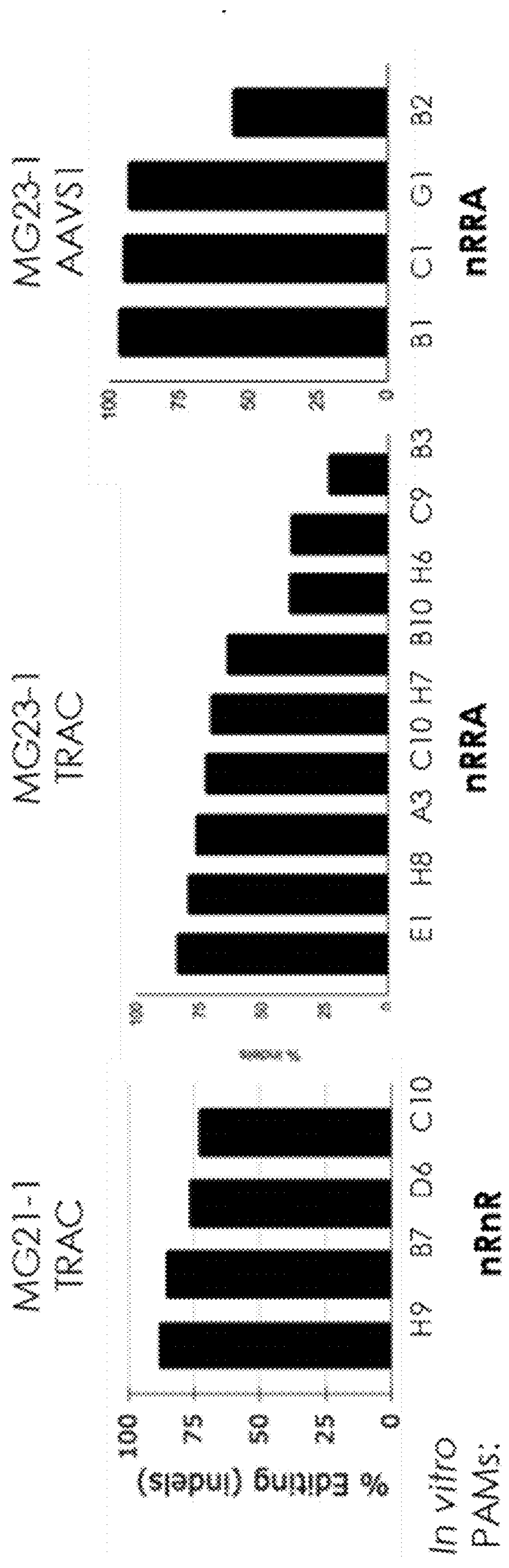
FIG. 18 depicts the gene editing outcomes at the DNA level for TRAC and AAVS1 in K562 cells.
Figure 18:
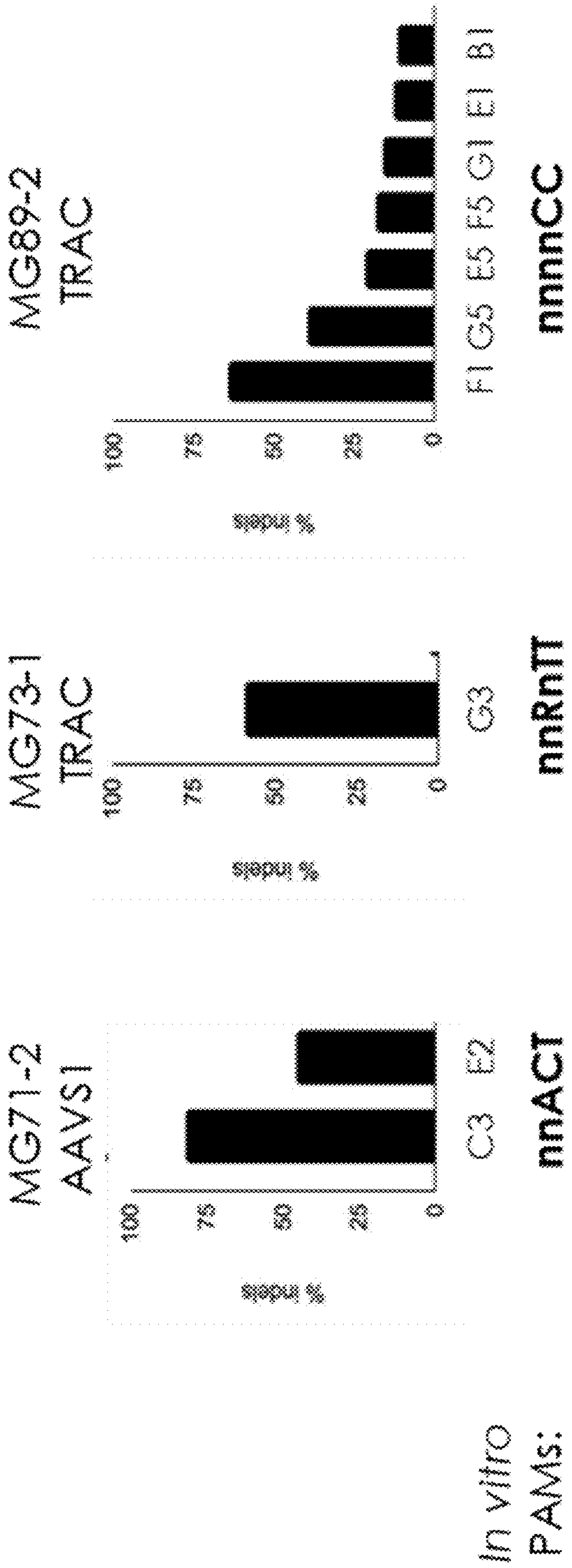

Example 25—Gene Editing Outcomes at the DNA Level for TRAC and AAVS1 in K562 Cells Nucleofection of MG21-1, MG23-1, MG73-1, MG89-2, and MG71-2 mRNA along with the matching guide RNA (500 ng mRNA/150 pmol guide) was performed into K562 cells (200,000) using the Lonza 4D electroporator. Cells were harvested and genomic DNA prepared three days post-transfection. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing (FIG. 18).

TABLE 15

Guide RNAs and Sequences Targeted for Example 25 When Targeting TRAC

| SEQ ID NO: | NAME | SEQUENCE |
|---|---|---|
| 7231 | MG21-1-TRAC-sgRNA-H9 | mC*mA*mC*rCrUrUrCrUrUrCrCrCrCrArGrCrCrCrArGrGrUrGrUrUrGrUrArGrUrUrCrCrCrCrUrUrUrUrGrArArArArArArArGrUrGrUrGrUrUrArCrUrGrCrArArUrArArGrGrUrArArArArCrArCrCrArCrGrArArGrCrUrCrUrGrCrCrCrUrArArCrUrGrCrCrUrUrArGrCrArGrUrUrArGrGrGrCrArUrC*mU*mU*mU |
| 7232 | MG21-1-TRAC-sgRNA-B7 | mC*mA*mA*rGrArGrCrArArCrArGrUrGrCrUrGrUrGrGrCrCrGrUrUrGrUrArGrUrUrCrCrCrCrUrUrUrUrGrArArArArArArArGrUrGrUrGrUrUrArCrUrGrCrArArUrArArGrGrUrArArArArCrArCrCrArCrGrArArGrCrUrCrUrGrCrCrCrUrArArCrUrGrCrCrUrUrArGrCrArGrUrUrArGrGrGrCrArUrC*mU*mU*mU |
| 7233 | MG21-1-TRAC-sgRNA-D6 | mA*mG*mA*rCrArUrGrArGrGrUrCrUrArUrGrGrArCrUrUrCrGrUrUrGrUrArGrUrUrCrCrCrCrUrUrUrUrGrArArArArArArArGrUrGrUrGrUrUrArCrUrGrCrArArUrArArGrGrUrArArArArCrArCrCrArCrGrArArGrCrUrCrUrGrCrCrCrUrArArCrUrGrCrCrUrUrArGrCrArGrUrUrArGrGrGrCrArUrC*mU*mU*mU |
| 7234 | MG21-1-TRAC-sgRNA-C10 | mC*mC*mA*rArArGrCrUrGrCrCrCrUrUrArCrCrUrGrGrGrCrGrUrUrGrUrArGrUrUrCrCrCrCrUrUrUrUrGrArArArArArArArGrUrGrUrGrUrUrArCrUrGrCrArArUrArArGrGrUrArArArArCrArCrCrArCrGrArArGrCrUrCrUrGrCrCrCrUrArArCrUrGrCrCrUrUrArGrCrArGrUrUrArGrGrGrCrArUrC*mU*mU*mU |
| 7235 | MG21-1-TRAC-target site-H9 | CACCTTCTTCCCCAGCCCAGGT |
| 7236 | MG21-1-TRAC-target site-B7 | CAAGAGCAACAGTGCTGTGGCC |
| 7237 | MG21-1-TRAC-target site-D6 | AGACATGAGGTCTATGGACTTC |
| 7238 | MG21-1-TRAC-target site-C10 | CCAAAGCTGCCCTTACCTGGGC |
| 7239 | MG23-1-TRAC-sgRNA-E1 | mC*mC*mG*rUrGrUrArCrCrArGrCrUrGrArGrArGrArCrUrCrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |

TABLE 15-continued

| Guide RNAs and Sequences Targeted for Example 25 When Targeting TRAC | | |
|---|---|---|
| SEQ ID NO: | NAME | SEQUENCE |
| 7240 | MG23-1-TRAC-sgRNA-H8 | mU*mU*mG*rGrGrUrUrCrCrGrArArUrCrCrUrCrCrUrCrCrUrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7241 | MG23-1-TRAC-sgRNA-A3 | mA*mC*mA*rGrUrGrCrUrGrUrGrGrCrCrUrGrGrArGrCrArArGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7242 | MG23-1-TRAC-sgRNA-C10 | mU*mG*mA*rArArGrUrUrUrArGrGrUrUrCrGrUrArUrCrUrGrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7243 | MG23-1-TRAC-sgRNA-H7 | mG*mC*mU*rUrGrArCrArUrCrArCrArGrGrArArCrUrUrUrCrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7244 | MG23-1-TRAC-sgRNA-B10 | mA*mA*mC*rCrCrArArUrCrArCrUrGrArCrArGrGrUrUrUrUrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7245 | MG23-1-TRAC-sgRNA-H6 | mC*mC*mU*rGrUrGrArUrGrUrCrArArGrCrUrGrGrUrCrGrArGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrUxmU*mU*mU |
| 7246 | MG23-1-TRAC-sgRNA-E7 | mU*mA*mG*rArCrCrCrCrUrGrUrCrUrUrArCrCrUrGrUrUrUrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7247 | MG23-1-TRAC-sgRNA-C9 | mA*mG*mC*rCrGrCrArGrCrGrUrCrArUrGrArGrCrArGrArUrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7248 | MG23-1-TRAC-target site-E1 | CCGTGTACCAGCTGAGAGACTC |
| 7249 | MG23-1-TRAC-target site-H8 | TTGGGTTCCGAATCCTCCTCCT |
| 7250 | MG23-1-TRAC-target site-A3 | ACAGTGCTGTGGCCTGGAGCAA |
| 7251 | MG23-1-TRAC-target site-C10 | TGAAAGTTTAGGTTCGTATCTG |
| 7252 | MG23-1-TRAC-target site-H7 | GCTTGACATCACAGGAACTTTC |
| 7253 | MG23-1-TRAC-target site-B10 | AACCCAATCACTGACAGGTTTT |
| 7254 | MG23-1-TRAC-target site-H6 | CCTGTGATGTCAAGCTGGTCGA |
| 7255 | MG23-1-TRAC-target site-E7 | TAGACCCCTGTCTTACCTGTTT |
| 7256 | MG23-1-TRAC-target site-C9 | AGCCGCAGCGTCATGAGCAGAT |

TABLE 15-continued

Guide RNAs and Sequences Targeted for Example 25 When Targeting TRAC

| SEQ ID NO: | NAME | SEQUENCE |
|---|---|---|
| 7269 | MG73-1-TRAC-sgRNA-G3 | mU*mC*mU*rUrGrGrUrUrUrUrArCrArGrArUrArCrGrArArCrCrUrGrUrUrArUrArGrUrGrGrGrArArArUrCrArCrUrArUrArArUrArArGrUrGrArArArUrCrGrCrArArGrGrCrUrCrUrGrUrUrCrUrUrGrArArCrArUrCrCrUrUrUrArUrUrArUrArArArArCrUrCrCrUrGrCrCrArArUrCrGrGrUrUrGrGrArGrU*mU*mU*mU |
| 7270 | MG73-1-TRAC-target site-G3 | TCTTGGTTTTACAGATACGAACCT |
| 7271 | MG89-2-TRAC-sgRNA-F1 | mA*mU*mA*rUrCrCrArGrArArCrCrCrUrGrArCrCrCrUrGrCrCrGrGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrU*mU*mU*mU |
| 7272 | MG89-2-TRAC-sgRNA-G5 | mG*mG*mC*rCrArCrUrUrUrCrArGrGrArGrGrArGrGrArUrUrCrGrGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrU*mU*mU*mU |
| 7273 | MG89-2-TRAC-sgRNA-E5 | mC*mG*mC*rArGrCrGrUrCrArUrGrArGrCrArGrArUrUrArArArCrGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrU*mU*mU*mU |
| 7274 | MG89-2-TRAC-sgRNA-F5 | mC*mG*mG*rCrCrArCrUrUrUrCrArGrGrArGrGrArGrGrArUrUrCrGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrU*mU*mU*mU |
| 7275 | MG89-2-TRAC-sgRNA-G1 | mG*mC*mC*rGrUrGrUrArCrCrArGrCrUrGrArGrArGrArCrUrCrUrGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrU*mU*mU*mU |
| 7276 | MG89-2-TRAC-sgRNA-E1 | mC*mC*mC*rArCrArGrArUrArUrCrCrArGrArArCrCrCrUrGrArCrGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrU*mU*mU*mU |
| 7277 | MG89-2-TRAC-sgRNA-B1 | mA*mU*mC*rCrUrCrUrUrGrUrCrCrCrArCrArGrArUrArUrCrCrArGrUrUrGrUrArGrCrUrUrCrCrUrUrGrArArGrArArArUrUrCrArArCrGrUrUrGrUrUrArCrArArUrArArGrGrUrUrUrUrCrGrArArArGrArUrUrArCrCrGrArArCrCrCrGrCrCrCrUrCrArCrUrUrArGrGrUrGrArGrGrGrCrUxmU*mU*mU |
| 7278 | MG89-2-TRAC-target site-F1 | ATATCCAGAACCCTGACCCTGCCG |
| 7279 | MG89-2-TRAC-target site-G5 | GGCCACTTTCAGGAGGAGGATTCG |
| 7280 | MG89-2-TRAC-target site-E5 | CGCAGCGTCATGAGCAGATTAAAC |
| 7281 | MG89-2-TRAC-target site-F5 | CGGCCACTTTCAGGAGGAGGATTC |
| 7282 | MG89-2-TRAC-target site-G1 | GCCGTGTACCAGCTGAGAGACTCT |

TABLE 15-continued

| Guide RNAs and Sequences Targeted for Example 25 When Targeting TRAC | | |
|---|---|---|
| SEQ ID NO: | NAME | SEQUENCE |
| 7283 | MG89-2-TRAC-target site-E1 | CCCACAGATATCCAGAACCCTGAC |
| 7284 | MG89-2-TRAC-target site-B1 | ATCCTCTTGTCCCACAGATATCCA |

r = native ribose base, m = 2'-O methyl modified base, F = 2' Fluro modified base, * = phosphorothioate bond

TABLE 16

| Guide RNAs and Sequences Targeted for Example 25 When Targeting AAVS1 | | |
|---|---|---|
| SEQ ID NO: | NAME | SEQUENCE |
| 7257 | MG23-1-AAVS1-sgRNA-B1 | mG*mC*mU*rArCrUrGrGrCrCrUrUrArUrCrUrCrArCrArGrGrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7258 | MG23-1-AAVS1-sgRNA-C1 | mC*mU*mA*rCrUrGrGrCrCrUrUrArUrCrUrCrArCrArGrGrUrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7259 | MG23-1-AAVS1-sgRNA-G1 | mA*mC*mU*rGrArCrGrCrArCrGrGrArGrGrArArCrArArUrArGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7260 | MG23-1-AAVS1-sgRNA-B2 | mG*mG*mA*rArCrArArUrArUrArArArUrUrGrGrGrGrArCrUrGrUrUrUrGrArGrArArCrCrUrGrArArArArGrGrUrGrArGrUrGrCrArArArUrArArGrGrUrUrUrArArCrCrGrArArArUrUrGrUrUrUrArCrCrUrGrCrArUrUrGrUrGrCrArGrUrArUrArArGrArArArGrArCrCrGrCrGrArGrGrUrCrU*mU*mU*mU |
| 7261 | MG23-1-AAVS1-target site-B1 | GCTACTGGCCTTATCTCACAGG |
| 7262 | MG23-1-AAVS1-target site-C1 | CTACTGGCCTTATCTCACAGGT |
| 7263 | MG23-1-AAVS1-target site-G1 | ACTGACGCACGGAGGAACAATA |
| 7264 | MG23-1-AAVS1-target site-B2 | GGAACAATATAAATTGGGGACT |
| 7265 | MG71-2-AAVS1-sgRNA-C3 | mG*mG*mA*rGrArGrGrGrUrArGrCrGrCrArGrGrGrUrGrGrUrUrUrGrArGrArGrUrGrArGrArArArUrCrArCrGrArGrUrUrCrArArArArArArCrArUrGrArUrUrUrArUrUrCrArArArCrCrGrUrCrUrUrCrUrUrCrGrGrArArGrGrCrCrCrCrArCrArGrUrGrUrGrUrGrGrArCrArGrUrArArArGrCrUrUrGrCrUrUrCrGrGrCrArArGrCrU*mU*mU*mU |
| 7266 | MG71-2-AAVS1-sgRNA-E2 | mG*mC*mC*rCrUrGrCrCrArGrGrArCrGrGrGrGrCrUrGrGrUrUrUrGrArGrArGrUrGrArGrArArArUrCrArCrGrArGrUrUrCrArArArArArArCrArUrGrArUrUrUrArUrUrCrArArArCrCrGrUrCrUrUrCrUrUrCrGrGrArArGrGrCrCrCrCrArCrArGrUrGrUrGrUrGrGrArCrArGrUrArArArGrCrUrUrGrCrUrUrCrGrGrCrArArGrCrU*mU*mU*mU |

TABLE 16-continued

| Guide RNAs and Sequences Targeted for Example 25 When Targeting AAVS1 | | |
|---|---|---|
| SEQ ID NO: | NAME | SEQUENCE |
| 7267 | MG71-2-AAVS1-target site-C3 | GGAGAGGGTAGCGCAGGGTG |
| 7268 | MG71-2-AAVS1-target site-E2 | GCCCTGCCAGGACGGGGCTG |

r = native ribose base, m = 2'-O methyl modified base, F = 2' Fluro modified base, * = phosphorothioate bond

Example 26—MG3-6 Nuclease Guide Screen for Human HAO-1 Gene Using mRNA Transfection of Hep3B Cells Guide RNAs for the MG3-6 nuclease targeting exons 1 to 4 of the human HAO-1 gene (encodes glycolate oxidase) were identified in silico by searching for the PAM sequence 5' NNRGRYY 3'. A total of 21 guides with the fewest predicted off-target sites in the human genome were chemically synthesized as single guide RNAs with AltR1/AltR2 end-modifications (IDT). The full sequences of the sgRNA are SEQ ID NOs: 11352-11372.

TABLE 17

| Guide sequences used in Example 26 | | |
|---|---|---|
| SEQ ID NO: | Entity Name | Sequence |
| 11352 | hH36-1 | AAUUAGCCGGGGGAGCAUUUUCGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11353 | hH36-2 | CCCAGACCUGUAAUAGUCAUAUGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11354 | hH36-3 | CCAAAGUCUAUAUAUGACUAUUGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11355 | hH36-4 | CAAAGUUUCUUCAUCAUUUGCCGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11356 | hH36-5 | GAUGCUCCGGAAUGUUGCUGAAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11357 | hH36-6 | CUCUGUCCUAAAACAGAAGUCGGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11358 | hH36-7 | UGUCGACUUCUGUUUUAGGACAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11359 | hH36-8 | GGGUCAGCAUGCCAAUAUGUGUGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11360 | hH36-9 | UCAUGCCCGUUCCCAGGGACUGGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11361 | hH36-10 | ACUCAACAUCAUGCCCGUUCCCGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11362 | hH36-11 | GAACGGGCAUGAUGUUGAGUUCGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11363 | hH36-12 | AGUUGCAGCCAACGAAGUGCCUGUUGAGAAUCGAAAGAUUCUUAAUAAGGCAUCCUUCCGAUGCUGACUUCUCACCGUCCGUUUUCCAAUAGGAGCGGGCGGUAUGUUUU |

TABLE 17-continued

Guide sequences used in Example 26

| SEQ ID NO: | Entity Name | Sequence |
|---|---|---|
| 11364 | hH36-13 | UUGGCUGCAACUGUAUAUCUACGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11365 | hH36-14 | GCUAGUGCGGCAGGCAGAGAAGGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11366 | hH36-15 | GGCAGGCAGAGAAGAUGGGCUAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11367 | hH36-16 | AACCGUCUGGAUGAUGUGCGUAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11368 | hH36-17 | GAGGAAAAUUUUGGAGACGACAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11369 | hH36-18 | UGCUGCAUAUGUGGCUAAAGCAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11370 | hH36-19 | UUGAUAUCUUCCCAGCUGAUAGGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11371 | hH36-20 | UGGGAAGAUAUCAAAUGGCUGAGUUGAGAAUCGAAAGAUUCUUAAUAAGGCAUCCUUCCGAUGCUGACUUCUCACCGUCCGUUUUCCAAUAGGAGCGGGCGGUAUGUUUU |
| 11372 | hH36-21 | AAUUGUUGCAAAGGGCAUUUUGGUUGAGAAUCGAAAGAUUCUUAAUAAGGCAUCCUUCCGAUGCUGACUUCUCACCGUCCGUUUUCCAAUAGGAGCGGGCGGUAUGUUUU |

Hep3B Transfection Protocol

The mRNA encoding MG3-6 was generated by T7 polymerase in vitro transcription of a plasmid in which the coding sequence of MG3-6 had been cloned. The MG3-6 coding sequence was codon optimized using human codon usage tables and flanked by nuclear localization signals derived from SV40 (at the N-terminus) and from Nucleoplasmin (at the C-terminus). In addition, a 5' untranslated region (5' UTR) was included at the 5' end of the coding sequence to improve translation. A 3' UTR followed by an approximately 90 to 110 nucleotide poly A tract was included in the mRNA (encoded in the plasmid) at the 3' end of the coding sequence to improve mRNA stability in vivo. The DNA sequence that encodes the MG3-6 mRNA without the polyA tail is shown in SEQ ID 22. The in vitro transcription reaction included the Clean Cap® capping reagent (Trilink BioTechnologies) and the resulting RNA was purified using the MEGAClear™ Transcription Clean-Up kit (Invitrogen) and purity was evaluated using the TapeStation (Agilent) and found to be composed of >90% full length RNA.

300 ng of MG3-6 mRNA and 120 ng of each single guide RNA were transfected into Hep3B cells as follows. One day prior to transfection, Hep3B cells that had been cultured for less than 10 days in EMEM-10% FBS-2 mM glutamine-1% NEAA media, without Pen/Step, were seeded into a TC-treated 24 well plate. Cells were counted, and the equivalent volume to 60,000 viable cells were added to each well. Additional pre-equilibrated media was added to each well to bring the total volume to 500 μL. On the day of transfection, 25 μL of OptiMEM media and 1.25 μL of Lipofectamine Messenger Max Solution (Thermo Fisher) were mixed in a master mix solution, vortexed, and allowed to sit for at least 5 minutes at room temperature. In separate tubes, 300 ng of the MG3-6/3-4 mRNA and 120 ng of the sgRNA were mixed with 25 μL of OptiMEM media and vortexed briefly. The appropriate volume of MessengerMax solution was added to each RNA solution, mixed by flicking the tube, and briefly spun down at a low speed. The complete editing reagent solutions were allowed to incubate for 10 minutes at room temperature, then added directly to the Hep3B cells. Two days post transfection, the media was aspirated from each well of Hep3B cells and genomic DNA was purified by automated magnetic bead purification on the KingFisher Flex robot with the MagMAX™ DNA Multi-Sample Ultra 2.0 Kit.

PCR Amplification and Editing Analysis by Sanger Sequencing

HAO-1 gene sequences targeted by the different sgRNA were amplified by PCR from purified genomic DNA using the exon-specific primers of Table 18 and Phusion Flash High-Fidelity PCR Master Mix (Thermo Fisher).

TABLE 18

Primers designed for the human HAO1 gene, used for PCR at each of the first four exons, and for Sanger sequencing.

| Target Exon | Use | Primer Name | Primer Sequence |
|---|---|---|---|
| Human | Fwd PCR | PCR_hHe1_F_+490 | TTTCATGGATGCCCCGTTCA |
| HAO1 | Rev PCR | PCR_hHe1_R_-412 | ACGAAAAGCCAGCAGGAAGA |
| Exon 1 | Sequencing | Seq_hHe1_R_-121 | AGCCCCAAGAACTTTTCCCT |
| Human | Fwd PCR | PCR_hHe2_F_+391 | TGCATCAGTGGTTGTCAGGG |
| HAO1 | Rev PCR | PCR_hHe2_R_-387 | CCTAGCTGTGACTTTGGGCA |
| Exon 2 | Sequencing | Seq_hHe2_R_-152 | TGGAAAGAAGAGGAGCAGGAC |
| Human | Fwd PCR | PCR_hHe3_F_+238 | AGGCTGGATGTTCAGGTTCTT |
| HAO1 | Rev PCR | PCR_hHe3_R_-212 | TCCCAAAGCCAAAGCCCTTA |
| Exon 3 | Sequencing | Seq_hHe3_F_+186 | AGCAGAAATAACTCCAGTAGCCA |
| Human | Fwd PCR | PCR_hHe4_F_+324 | GCTGGCTGAAAATCGTGTCAA |
| HAO1 | Rev PCR | PCR_hHe4_R_-348 | TCCTTGGGGCTTCTCTTTGG |
| Exon 4 | Sequencing | Seq_hHe4_F_+174 | ACTGATTAAGACCACTAGAGTATCACA |

PCR products were purified and concentrated using DNA clean & concentrator 5 (Zymo Research) and 40 ng of PCR product subjected to Sanger sequencing (ELIM Biosciences).

Figure 19:
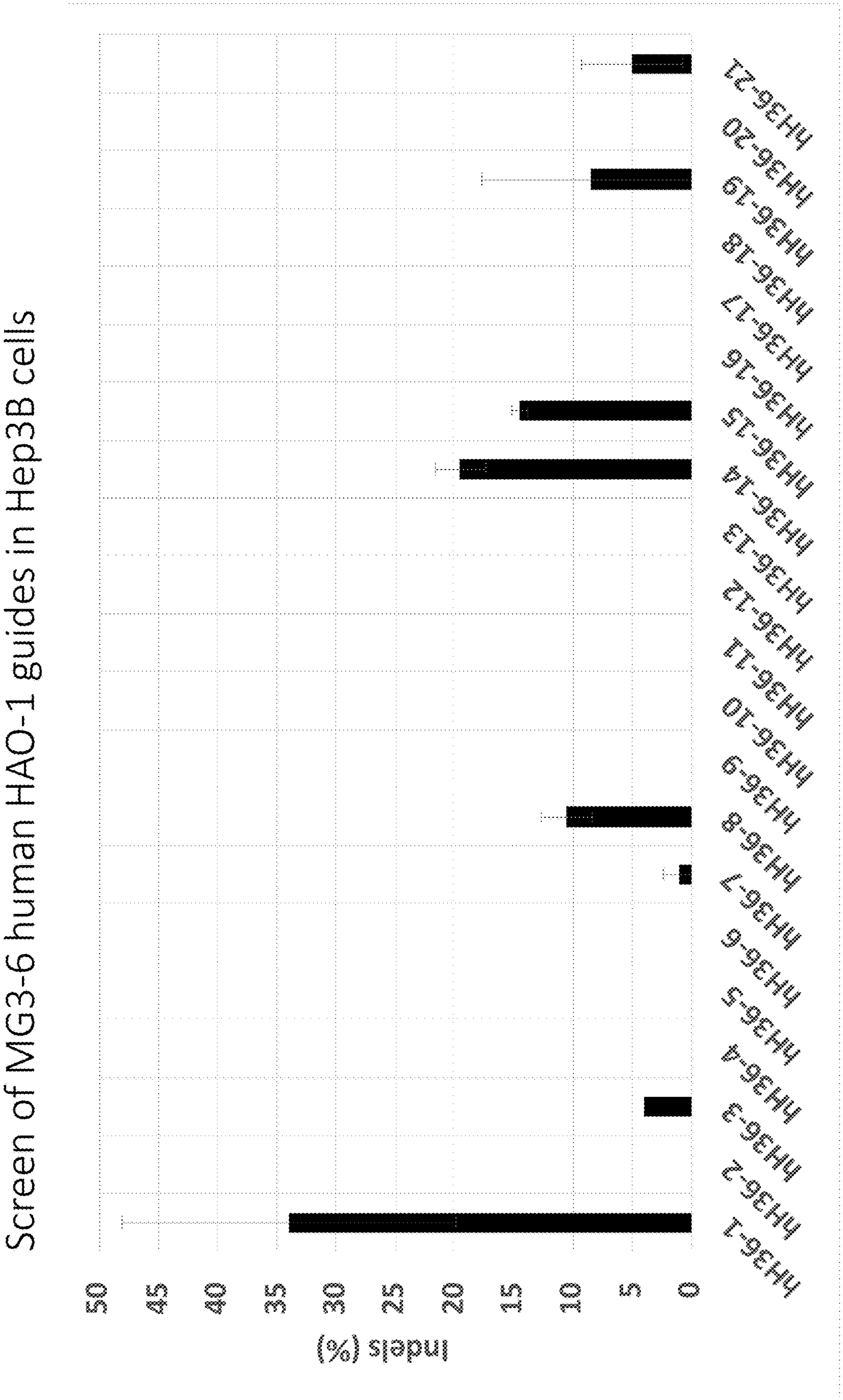
FIG. 19 depicts the activity of chemically modified MG3-6 human HAO-1 guides in Hep3B cells when delivered as mRNA and gRNA using Lipofectamine Messenger Max.

The Sanger sequencing chromatograms were analyzed for insertions and deletions (INDELS) at the predicted target site for each sgRNA by an algorithm called Tracking of Indels by DEcomposition (TIDE) as described by Brinkman et al. (Nucleic Acids Res. 2014 Dec. 16; 42(22): e168. Published online 2014 Oct. 9. doi: 10.1093/nar/gku936). From this screen guides hH364-1, 14, and 15 were identified as having the highest editing activity in Hep3B cells (FIG. 19 and Table 19).

TABLE 19

Editing activity of MG3-6 guides at human HAO1 gene delivered by mRNA transfection

| Guide Name | PAM | Spacer Sequence | Editing Activity in Hep3B (Average % indels) | Spacer Sequence SEQ ID NO: |
|---|---|---|---|---|
| hH36-1 | ACAGGTT | AATTAGCCGGGGGAGCATTTTC | 34.0 | 11773 |
| hH36-2 | ATAGACT | CCCAGACCTGTAATAGTCATAT | 0.0 | 11774 |
| hH36-3 | ACAGGTC | CCAAAGTCTATATATGACTATT | 4.0 | 11775 |
| hH36-4 | CCAGACC | CAAAGTTTCTTCATCATTTGCC | 0.0 | 11776 |
| hH36-5 | ACAGATC | GATGCTCCGGAATGTTGCTGAA | 0.0 | 11777 |
| hH36-6 | ACAGATC | CTCTGTCCTAAAACAGAAGTCG | 0.0 | 11778 |
| hH36-7 | GAGGGTC | TGTCGACTTCTGTTTTAGGACA | 1.0 | 11779 |
| hH36-8 | GGGGGCT | GGGTCAGCATGCCAATATGTGT | 10.5 | 11780 |
| hH36-9 | ACAGGCT | TCATGCCCGTTCCCAGGGACTG | 0.0 | 11781 |
| hH36-10 | AGGGACT | ACTCAACATCATGCCCGTTCCC | 0.0 | 11782 |
| hH36-11 | CTGGGCC | GAACGGGCATGATGTTGAGTTC | 0.0 | 11783 |
| hH36-12 | CAGGACC | AGTTGCAGCCAACGAAGTGCCT | 0.0 | 11784 |

TABLE 19-continued

Editing activity of MG3-6 guides at human HAO1 gene delivered by mRNA transfection

| Guide Name | PAM | Spacer Sequence | Editing Activity in Hep3B (Average % indels) | Spacer Sequence SEQ ID NO: |
|---|---|---|---|---|
| hH36-13 | AAGGACC | TTGGCTGCAACTGTATATCTAC | 0.0 | 11785 |
| hH36-14 | ATGGGCT | GCTAGTGCGGCAGGCAGAGAAG | 19.5 | 11786 |
| hH36-15 | CAAGGCC | GGCAGGCAGAGAAGATGGGCTA | 14.5 | 11787 |
| hH36-16 | ACAGATT | AACCGTCTGGATGATGTGCGTA | 0.0 | 11788 |
| hH36-17 | GTGGACT | GAGGAAAATTTTGGAGACGACA | 0.0 | 11789 |
| hH36-18 | ATAGACC | TGCTGCATATGTGGCTAAAGCA | 0.0 | 11790 |
| hH36-19 | ATGGGTC | TTGATATCTTCCCAGCTGATAG | 8.5 | 11791 |
| hH36-20 | GAAGACT | TGGGAAGATATCAAATGGCTGA | 0.0 | 11792 |
| hH36-21 | AGAGGTT | AATTGTTGCAAAGGGCATTTTG | 5.0 | 11793 |

Example 27—Gene Editing Outcomes at the DNA Level for Human GPR146

Figure 20:
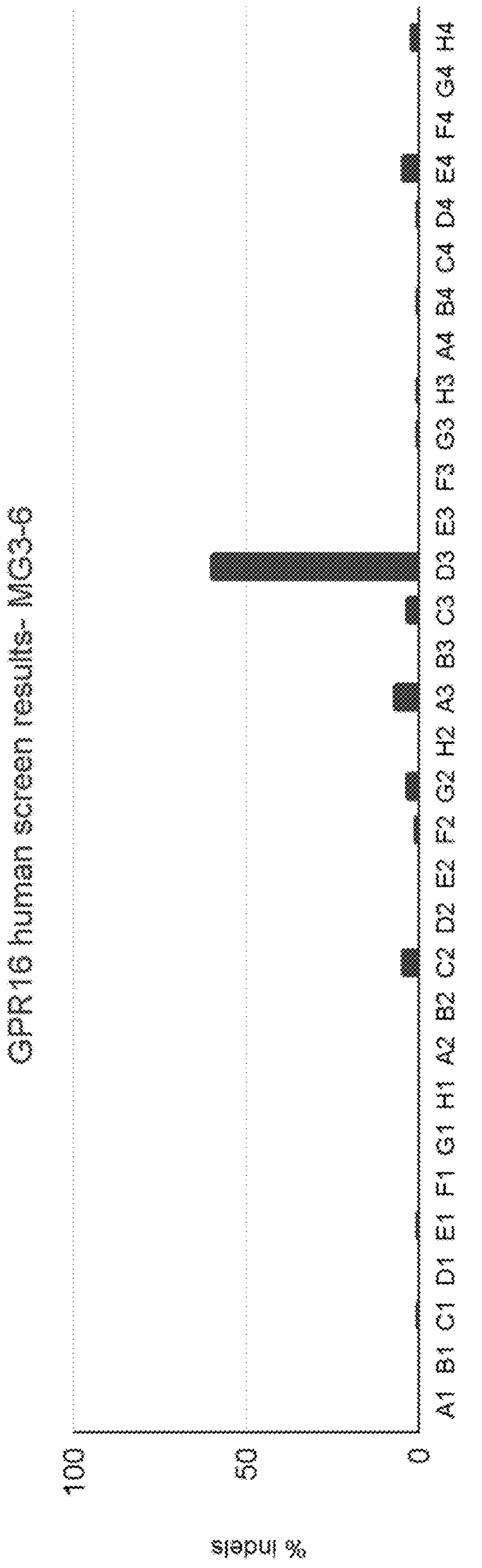
FIG. 20 depicts the gene editing outcomes at the DNA level for human GPR146 in Hep3B cells.

Nucleofection of MG3-6 RNPs (104 pmol protein/120 pmol guide) (SEQ ID NOs: 11374-11405) was performed into Hep3B cells (100,000) using the Lonza 4D electroporator. Cells were harvested and genomic DNA prepared three days post-transfection. PCR primers appropriate for use in NGS-based DNA sequencing were generated, optimized, and used to amplify the individual target sequences for each guide RNA (SEQ ID NOs: 11406-11437). The amplicons were sequenced on an Illumina MiSeq machine and analyzed with a proprietary Python script to measure gene editing (FIG. 20).

TABLE 20

Guide RNAs and Sequences Targeted for Example 25 When Targeting GPR146

| SEQ ID NO: | NAME | SEQUENCE |
|---|---|---|
| 11374 | MG3-6-human GPR146-A1 | mA*mG*mC*rUrGrCrArGrCrUrGrGrUrUrCrArArCrGrGrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 11375 | MG3-6-human GPR146-B1 | mG*mG*mU*rGrGrArGrGrArGrCrUrGrCrCrUrGrCrCrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrUxmU*mU*mU |
| 11376 | MG3-6-human GPR146-C1 | mC*mC*mU*rGrCrCrUrGrCrCrArGrGrArCrCrUrGrCrArGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 11377 | MG3-6-human GPR146-D1 | mG*mG*mG*rGrCrUrGrUrCrArCrUrGrUrUrGrUrCrGrCrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrUrCrCrArArUrArGrGrArGrCrGrGrGrCrGrGrUrArUrGrU*mU*mU*mU |
| 11378 | MG3-6-human GPR146-E1 | mG*mG*mG*rCrCrUrGrGrUrGrGrUrGrGrGrCrGrUrGrCrCrArGrUrUrGrArGrArArUrCrGrArArArGrArUrUrCrUrUrArArUrAr |

TABLE 20-continued

Guide RNAs and Sequences Targeted for Example 25 When Targeting GPR146

| SEQ ID NO: | NAME | SEQUENCE |
|---|---|---|
| | | ArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11379 | MG3-6-human GPR146-F1 | mU*mG*mG*rUrGrCrUrGrGrCrCrArArCrCrUrArCrArCrArGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11380 | MG3-6-human GPR146-G1 | mG*mU*mA*rCrUrUrUrGrUrCrArArCrArUrGrGrCrArGrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11381 | MG3-6-human GPR146-H1 | mG*mC*mG*rGrCrGrArArGrUrCrCrArCrGrUrGrGrCrArCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11382 | MG3-6-human GPR146-A2 | mA*mC*mU*rArCrArUrCrGrArGrCrGrUrGrCrArCrUrGrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11383 | MG3-6-human GPR146-B2 | mC*mG*mU*rCrCrGrCrArGrGrGrArGrGrArCrArCrGrCrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11384 | MG3-6-human GPR146-C2 | mG*mG*mA*rCrArCrGrCrCrCrCrUrGrGrArCrCrGrGrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11385 | MG3-6-human GPR146-D2 | mG*mG*mC*rCrGrGrCrUrGrGrArGrCrCrCrUrCrGrGrCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11386 | MG3-6-human GPR146-E2 | mG*mU*mG*rGrCrCrArCrCrGrUrGrUrGrCrArCrGrCrArGrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11387 | MG3-6-human GPR146-F2 | mA*mA*mG*rCrCrCrGrUrGrGrArCrGrCrArCrArCrUrArCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11388 | MG3-6-human GPR146-G2 | mC*mC*mU*rGrGrGrCrUrArCrUrGrCrArCrUrUrUrGrUrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11389 | MG3-6-human GPR146-H2 | mG*mC*mU*rGrArUrGrArArArArArGrCrUrGrCrCrCrUrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11390 | MG3-6-human GPR146-A3 | mC*mU*mG*rCrGrGrGrArCrCrGrGrCrArCrUrGrCrUrCrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |

TABLE 20-continued

Guide RNAs and Sequences Targeted for Example 25 When Targeting GPR146

| SEQ ID NO: | NAME | SEQUENCE |
|---|---|---|
| 11391 | MG3-6-human GPR146-B3 | mG*mU*mG*rGrUrGrUrCrArCrArArArGrCrUrGrCrUrGrGrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11392 | MG3-6-human GPR146-C3 | mU*mA*mG*rCrCrCrCrArGrGrUrArGrUrGrUrGrCrGrUrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11393 | MG3-6-human GPR146-D3 | mA*mG*mA*rUrGrArUrGrArCrCrGrUrGrUrGrCrCrCrCrArGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11394 | MG3-6-human GPR146-E3 | mG*mG*mC*rCrArCrCrArGrCrArGrCrCrUrGrUrGrUrGrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11395 | MG3-6-human GPR146-F3 | mG*mC*mG*rUrGrUrUrGrUrArCrArCrGrCrUrGrGrCrCrArUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11396 | MG3-6-human GPR146-G3 | mA*mG*mU*rGrCrArCrGrCrUrCrGrArUrGrUrArGrUrGrGrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11397 | MG3-6-human GPR146-H3 | mC*mC*mA*rCrCrArGrUrGrArGrGrArCrArCrArUrUrGrArArG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrCrCrArArUrArGrGrArGrCrGrGr GrCrGrGrUrArUrGrU*mU*mU*mU |
| 11398 | MG3-6-human GPR146-A4 | mU*mG*mA*rArGrGrGrGrArUrCrUrGrCrArGrUrGrCrCrArCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11399 | MG3-6-human GPR146-B4 | mC*mA*mC*rArGrCrGrCrCrCrArCrCrGrGrGrArGrCrUrCrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11400 | MG3-6-human GPR146-C4 | mU*mC*mG*rGrGrGrGrGrCrCrGrArGrCrArGrGrUrGrCrArCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11401 | MG3-6-human GPR146-D4 | mA*mC*mA*rGrGrGrGrCrCrArGrGrGrCrGrCrUrGrArGrCrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrUmU*mU*mU |
| 11402 | MG3-6-human GPR146-E4 | mA*mU*mG*rGrUrCrArUrGrCrUrGrGrCrCrUrUrGrCrUrGrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11403 | MG3-6-human GPR146-F4 | mA*mG*mC*rArCrCrArGrCrArGrGrGrCrGrUrUrGrUrArGrCr GrUrUrGrArGrArArUrCrGrArArArGrArUrUrCrUrUrArArUrAr |

TABLE 20-continued

Guide RNAs and Sequences Targeted for Example 25 When Targeting GPR146

| SEQ ID NO: | NAME | SEQUENCE |
|---|---|---|
| | | ArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11404 | MG3-6-human GPR146-G4 | mA*mG*mG*rCrCrCrArCrUrGrGrCrArCrGrCrCrCrArCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11405 | MG3-6-human GPR146-H4 | mG*mA*mC*rArArCrArGrUrGrArCrArGrCrCrCrCrArGrCrUrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11406 | MG3-6-human GPR146-A1 | AGCTGCAGCTGGTTCAACGGCA |
| 11407 | MG3-6-human GPR146-B1 | GGTGGAGGAGCTGCCTGCCTGC |
| 11408 | MG3-6-human GPR146-C1 | CCTGCCTGCCAGGACCTGCAGC |
| 11409 | MG3-6-human GPR146-D1 | GGGGCTGTCACTGTTGTCGCTG |
| 11410 | MG3-6-human GPR146-E1 | GGGCCTGGTGGTGGGCGTGCCA |
| 11411 | MG3-6-human GPR146-F1 | TGGTGCTGGCCAACCTACACAG |
| 11412 | MG3-6-human GPR146-G1 | GTACTTTGTCAACATGGCAGTG |
| 11413 | MG3-6-human GPR146-H1 | GCGGCGAAGTCCACGTGGCACT |
| 11414 | MG3-6-human GPR146-A2 | ACTACATCGAGCGTGCACTGCC |
| 11415 | MG3-6-human GPR146-B2 | CGTCCGCAGGGAGGACACGCCC |
| 11416 | MG3-6-human GPR146-C2 | GGACACGCCCCTGGACCGGGAC |
| 11417 | MG3-6-human GPR146-D2 | GGCCGGCTGGAGCCCTCGGCAC |
| 11418 | MG3-6-human GPR146-E2 | GTGGCCACCGTGTGCACGCAGT |
| 11419 | MG3-6-human GPR146-F2 | AAGCCCGTGGACGCACACTACC |
| 11420 | MG3-6-human GPR146-G2 | CCTGGGGCTACTGCACTTTGTG |
| 11421 | MG3-6-human GPR146-H2 | GCTGATGAAAAAGCTGCCCTGC |
| 11422 | MG3-6-human GPR146-A3 | CTGCGGGGACCGGCACTGCTCC |
| 11423 | MG3-6-human GPR146-B3 | GTGGTGTCACAAAGCTGCTGGA |
| 11424 | MG3-6-human GPR146-C3 | TAGCCCCAGGTAGTGTGCGTCC |
| 11425 | MG3-6-human GPR146-D3 | AGATGATGACCGTGTGCCCCAG |

TABLE 20-continued

Guide RNAs and Sequences Targeted for Example 25 When Targeting GPR146

| SEQ ID NO: | NAME | SEQUENCE |
|---|---|---|
| 11426 | MG3-6-human GPR146-E3 | GGCCACCAGCAGCCTGTGTGCC |
| 11427 | MG3-6-human GPR146-F3 | GCGTGTTGTACACGCTGGCCAT |
| 11428 | MG3-6-human GPR146-G3 | AGTGCACGCTCGATGTAGTGGT |
| 11429 | MG3-6-human GPR146-H3 | CCACCAGTGAGGACACATTGAA |
| 11430 | MG3-6-human GPR146-A4 | TGAAGGGGATCTGCAGTGCCAC |
| 11431 | MG3-6-human GPR146-B4 | CACAGCGCCCACCGGGAGCTCG |
| 11432 | MG3-6-human GPR146-C4 | TCGGGGGGCCGAGCAGGTGCAC |
| 11433 | MG3-6-human GPR146-D4 | ACAGGGGCCAGGGCGCTGAGCA |
| 11434 | MG3-6-human GPR146-E4 | ATGGTCATGCTGGCCTTGCTGT |
| 11435 | MG3-6-human GPR146-F4 | AGCACCAGCAGGGCGTTGTAGC |
| 11436 | MG3-6-human GPR146-G4 | AGGCCCACTGGCACGCCCACCA |
| 11437 | MG3-6-human GPR146-H4 | GACAACAGTGACAGCCCCAGCT |

r = native ribose base, m = 2'-O methyl modified base, F = 2' Fluro modified base, * = phosphorothioate bond

Figure 21:
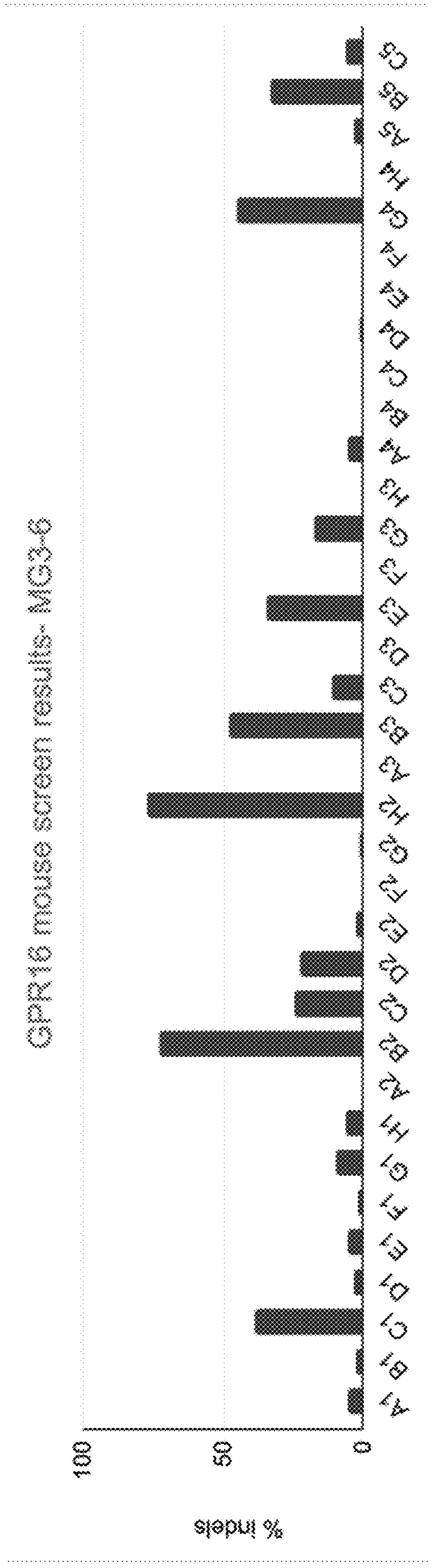
FIG. 21 depicts the gene editing outcomes at the DNA level for mouse GPR146 in Hepa1-6 cells.

Example 28—Gene Editing Outcomes at the DNA Level for Mouse GPR146 in Hepa1-6 Cells Nucleofection of MG3-6 RNPs (104 pmol protein/120 pmol guide) (SEQ ID NOs: 11438-11472) was performed into Hepa1-6 cells (100,000) using the Lonza 4D electroporator. Cells were harvested and genomic DNA prepared five days post-transfection. PCR primers appropriate for use in NGS-based DNA sequencing were generated, optimized, and used to amplify the individual target sequences for each guide RNA (SEQ ID NOs: 11473-11507). The amplicons were sequenced on an Illumina MiSeq machine and analyzed with a proprietary Python script to measure gene editing (FIG. 21).

TABLE 21

Guide RNAs and Sequences Targeted for Example 25 When Targeting GPR146

| SEQ ID NO: | NAME | SEQUENCE |
|---|---|---|
| 11438 | MG3-6-mouse GPR146-A1 | mG*mU*mG*rGrCrCrCrArCrUrCrArArCrArGrCrArCrArGrCrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrUrCrCrArArUrArGrGrArGrCrGrGr GrCrGrGrUrArUrGrU*mU*mU*mU |
| 11439 | MG3-6-mouse GPR146-B1 | mC*mC*mG*rCrUrGrUrGrCrCrGrGrArArCrCrUrGrCrGrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11440 | MG3-6-mouse GPR146-C1 | mG*mC*mC*rGrGrArArCrCrUrGrCrGrCrCrUrGrGrGrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |

TABLE 21-continued

Guide RNAs and Sequences Targeted for Example 25 When Targeting GPR146

| SEQ ID NO: | NAME | SEQUENCE |
|---|---|---|
| 11441 | MG3-6-mouse GPR146-D1 | mU*mC*mU*rCrGrCrUrGrCrUrCrUrArCrCrUrGrGrGrGrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11442 | MG3-6-mouse GPR146-E1 | mG*mG*mG*rGrGrCrArGrGrGrGrUrCrCrCrUrGrUrGrArGrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11443 | MG3-6-mouse GPR146-F1 | mU*mA*mC*rUrUrCrGrUrGrArArCrArUrGrGrCrCrGrUrGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11444 | MG3-6-mouse GPR146-G1 | mG*mG*mC*rArCrUrGrGrCrArCrCrUrGrCrGrUrArCrCrUrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11445 | MG3-6-mouse GPR146-H1 | mU*mG*mU*rUrGrGrGrCrCrCrUrGrCrCrCrArCrUrCrCrArGrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrUrCrCrArArUrArGrGrArGrCrGrGr GrCrGrGrUrArUrGrU*mU*mU*mU |
| 11446 | MG3-6-mouse GPR146-A2 | mG*mG*mG*rCrCrCrUrGrUrGrGrArGrCrCrUrCrArGrCrArGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11447 | MG3-6-mouse GPR146-B2 | mU*mG*mU*rGrCrUrCrArUrCrGrGrCrUrArCrGrUrGrGrUrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11448 | MG3-6-mouse GPR146-C2 | mA*mA*mU*rCrGrGrGrArArGrGrArArGrArCrArCrArCrCrCrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrUrCrCrArArUrArGrGrArGrCrGrGr GrCrGrGrUrArUrGrU*mU*mU*mU |
| 11449 | MG3-6-mouse GPR146-D2 | mA*mC*mA*rCrCrCrCrUrGrGrArCrCrArGrGrArCrArCrCrArG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrUrCrCrArArUrArGrGrArGrCrGrGr GrCrGrGrUrArUrGrU*mU*mU*mU |
| 11450 | MG3-6-mouse GPR146-E2 | mC*mC*mU*rGrGrArCrCrArGrGrArCrArCrCrArGrCrArGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11451 | MG3-6-mouse GPR146-F2 | mA*mG*mC*rArGrGrCrUrGrGrArCrCrCrCrUrCrGrGrUrGrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11452 | MG3-6-mouse GPR146-G2 | mA*mC*mA*rCrArGrUrGrCrUrGrArCrGrUrCrArCrGrGrGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrUrCrCrArArUrArGrGrArGrCrGr GrGrCrGrGrUrArUrGrU*mU*mU*mU |
| 11453 | MG3-6-mouse GPR146-H2 | mA*mG*mG*rGrGrCrArUrUrArUrCrUrGrGrGrCrArUrCrCrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr |

TABLE 21-continued

Guide RNAs and Sequences Targeted for Example 25 When Targeting GPR146

| SEQ ID NO: | NAME | SEQUENCE |
|---|---|---|
| | | CrArCrCrGrUrCrCrGrUrUrUrCrCrArArUrArGrGrArGrCrGr GrGrCrGrGrUrArUrGrU*mU*mU*mU |
| 11454 | MG3-6-mouse GPR146-A3 | mU*mC*mU*rGrGrGrCrArUrCrCrUrArCrArGrGrUrUrGrCrUrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrCrCrArArUrArGrGrArGrCrGrGr GrCrGrGrUrArUrGrU*mU*mU*mU |
| 11455 | MG3-6-mouse GPR146-B3 | mG*mC*mC*rArUrCrArCrCrUrGrCrUrGrUrArUrCrCrCrCrGrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrCrCrArArUrArGrGrArGrCrGrGr GrCrGrGrUrArUrGrU*mU*mU*mU |
| 11456 | MG3-6-mouse GPR146-C3 | mU*mC*mA*rGrCrCrGrCrCrGrGrArGrCrUrUrGrCrCrGrGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11457 | MG3-6-mouse GPR146-D3 | mG*mU*mG*rGrUrGrUrCrArCrArGrArArCrUrGrCrUrUrGrAr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11458 | MG3-6-mouse GPR146-E3 | mC*mU*mU*rGrArGrArArGrGrCrCrArGrGrArArCrUrUrGrGr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11459 | MG3-6-mouse GPR146-F3 | mC*mG*mU*rGrArCrGrUrCrArGrCrArCrUrGrUrGrUrGrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11460 | MG3-6-mouse GPR146-G3 | mA*mG*mG*rCrUrCrArArGrUrArGrUrArArGrGrUrGrUrCrCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrUmU*mU*mU |
| 11461 | MG3-6-mouse GPR146-H3 | mG*mC*mC*rArCrCrArGrCrArGrCrCrUrGrUrGrCrArCrCrGrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrCrCrArArUrArGrGrArGrCrGrGr GrCrGrGrUrArUrGrU*mU*mU*mU |
| 11462 | MG3-6-mouse GPR146-A4 | mA*mG*mU*rGrCrCrArGrGrGrCrArUrArCrArArCrArCrArGrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrCrCrArArUrArGrGrArGrCrGrGr GrCrGrGrUrArUrGrU*mU*mU*mU |
| 11463 | MG3-6-mouse GPR146-B4 | mA*mG*mG*rGrCrArCrGrCrUrCrGrArUrGrUrArGrUrArGrUr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrUxmU*mU*mU |
| 11464 | MG3-6-mouse GPR146-C4 | mU*mG*mA*rArCrArGrGrArUrGrArGrCrArGrUrGrUrCrArCr GrUrUrGrArGrArArUrCrGrArArArGrArUrUrCrUrUrArArUrAr ArGrGrCrArUrCrCrUrUrCrCrGrArUrGrCrUrGrArCrUrUrCrUr CrArCrCrGrUrCrCrGrUrUrUrCrCrArArUrArGrGrArGrCrGr GrGrCrGrGrUrArUrGrU*mU*mU*mU |
| 11465 | MG3-6-mouse GPR146-D4 | mA*mG*mU*rGrUrCrArCrArUrGrGrGrCrCrUrCrArCrUrGrCrG rUrUrGrArGrArArUrCrGrArArArGrArUrUrCrUrUrArArUrArAr GrGrCrArUrCrCrUrUrCrCrGrArUrGrCrUrGrArCrUrUrCrUrCr ArCrCrGrUrCrCrGrUrUrUrCrCrArArUrArGrGrArGrCrGrGr GrCrGrGrUrArUrGrU*mU*mU*mU |

TABLE 21-continued

Guide RNAs and Sequences Targeted for Example 25 When Targeting GPR146

| SEQ ID NO: | NAME | SEQUENCE |
|---|---|---|
| 11466 | MG3-6-mouse GPR146-E4 | mG*mG*mG*rCrCrUrCrArCrUrGrCrUrGrArGrGrCrUrCrCrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11467 | MG3-6-mouse GPR146-F4 | mC*mA*mC*rArGrGrCrCrCrArCrCrUrGrGrArGrUrGrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11468 | MG3-6-mouse GPR146-G4 | mA*mU*mG*rGrUrCrArUrGrGrUrGrUrUrCrUrUrGrCrUrGrGrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11469 | MG3-6-mouse GPR146-H4 | mG*mA*mG*rCrArUrUrArUrArGrCrCrUrArArGrCrUrCrArCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11470 | MG3-6-mouse GPR146-A5 | mC*mU*mG*rCrCrCrCrCrArGrGrUrArGrArGrCrArGrCrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11471 | MG3-6-mouse GPR146-B5 | mG*mA*mG*rArGrGrArCrCrCrArCrArGrCrCrCrCrArGrGrCrGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11472 | MG3-6-mouse GPR146-C5 | mU*mC*mA*rGrCrCrArCrGrCrUrGrUrGrCrUrGrUrUrGrArGrUrUrGrArGrArArUrCrGrArArArGrArUrUrCrUrUrArArUrArArGrGrCrArUrCrCrUrUrCrCrGrArUrGrCrUrGrArCrUrUrCrUrCrArCrCrGrUrCrCrGrUrUrUrCrCrArArUrArGrGrArGrCrGrGrGrCrGrGrUrArUrGrU*mU*mU*mU |
| 11473 | MG3-6-mouse GPR146-A1 | GTGGCCCACTCAACAGCACAGC |
| 11474 | MG3-6-mouse GPR146-B1 | CCGCTGTGCCGGAACCTGCGCC |
| 11475 | MG3-6-mouse GPR146-C1 | GCCGGAACCTGCGCCTGGGGCT |
| 11476 | MG3-6-mouse GPR146-D1 | TCTCGCTGCTCTACCTGGGGGC |
| 11477 | MG3-6-mouse GPR146-E1 | GGGGGCAGGGGTCCCTGTGAGC |
| 11478 | MG3-6-mouse GPR146-F1 | TACTTCGTGAACATGGCCGTGG |
| 11479 | MG3-6-mouse GPR146-G1 | GGCACTGGCACCTGCGTACCTG |
| 11480 | MG3-6-mouse GPR146-H1 | TGTTGGGCCCTGCCCACTCCAG |
| 11481 | MG3-6-mouse GPR146-A2 | GGGCCCTGTGGAGCCTCAGCAG |
| 11482 | MG3-6-mouse GPR146-B2 | TGTGCTCATCGGCTACGTGGTG |
| 11483 | MG3-6-mouse GPR146-C2 | AATCGGGAAGGAAGACACACCC |

TABLE 21-continued

Guide RNAs and Sequences Targeted for Example 25 When Targeting GPR146

| SEQ ID NO: | NAME | SEQUENCE |
|---|---|---|
| 11484 | MG3-6-mouse GPR146-D2 | ACACCCCTGGACCAGGACACCA |
| 11485 | MG3-6-mouse GPR146-E2 | CCTGGACCAGGACACCAGCAGG |
| 11486 | MG3-6-mouse GPR146-F2 | AGCAGGCTGGACCCCTCGGTGC |
| 11487 | MG3-6-mouse GPR146-G2 | ACACAGTGCTGACGTCACGGGG |
| 11488 | MG3-6-mouse GPR146-H2 | AGGGGCATTATCTGGGCATCCT |
| 11489 | MG3-6-mouse GPR146-A3 | TCTGGGCATCCTACAGGTTGCT |
| 11490 | MG3-6-mouse GPR146-B3 | GCCATCACCTGCTGTATCCCCG |
| 11491 | MG3-6-mouse GPR146-C3 | TCAGCCGCCGGAGCTTGCCGGG |
| 11492 | MG3-6-mouse GPR146-D3 | GTGGTGTCACAGAACTGCTTGA |
| 11493 | MG3-6-mouse GPR146-E3 | CTTGAGAAGGCCAGGAACTTGG |
| 11494 | MG3-6-mouse GPR146-F3 | CGTGACGTCAGCACTGTGTGCC |
| 11495 | MG3-6-mouse GPR146-G3 | AGGCTCAAGTAGTAAGGTGTCC |
| 11496 | MG3-6-mouse GPR146-H3 | GCCACCAGCAGCCTGTGCACCG |
| 11497 | MG3-6-mouse GPR146-A4 | AGTGCCAGGGCATACAACACAG |
| 11498 | MG3-6-mouse GPR146-B4 | AGGGCACGCTCGATGTAGTAGT |
| 11499 | MG3-6-mouse GPR146-C4 | TGAACAGGATGAGCAGTGTCAC |
| 11500 | MG3-6-mouse GPR146-D4 | AGTGTCACATGGGCCTCACTGC |
| 11501 | MG3-6-mouse GPR146-E4 | GGGCCTCACTGCTGAGGCTCCA |
| 11502 | MG3-6-mouse GPR146-F4 | CACAGGGCCCACCTGGAGTGGG |
| 11503 | MG3-6-mouse GPR146-G4 | ATGGTCATGGTGTTCTTGCTGG |
| 11504 | MG3-6-mouse GPR146-H4 | GAGCATTATAGCCTAAGCTCAC |
| 11505 | MG3-6-mouse GPR146-A5 | CTGCCCCCAGGTAGAGCAGCGA |
| 11506 | MG3-6-mouse GPR146-B5 | GAGAGGACCCACAGCCCCAGGC |
| 11507 | MG3-6-mouse GPR146-C5 | TCAGCCCACGCTGTGCTGTTGA |

r = native ribose base, m = 2'-O methyl modified base, F = 2' Fluro modified base, * = phosphorothioate bond

Figure 22:
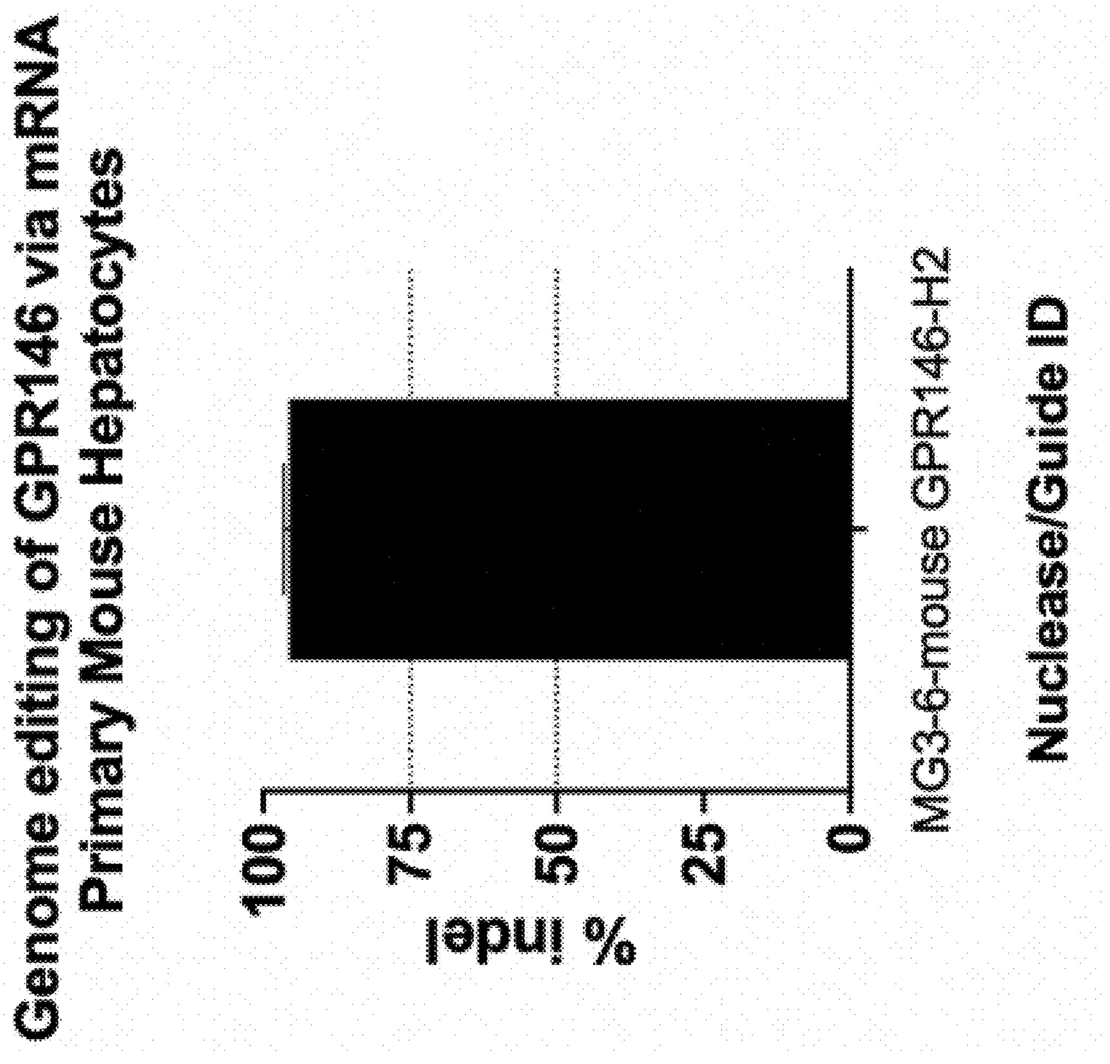
FIG. 22 depicts the gene editing outcomes at the DNA level for mouse GPR146 in primary mouse hepatocytes.

Example 29—Gene Editing Outcomes at the DNA Level for Mouse GPR146 in Primary Mouse Hepatocytes Lipofection with MessengerMax of MG3-6 mRNA and guide (0.42 ug mRNA, 1:20 nuclease:guide molar ratio) was performed in primary mouse hepatocytes (1E5 viable cells/guide) using the guide RNAs described in Example 29 above. Cells were harvested and genomic DYNA prepared three days post-transfection. PCR primers appropriate for use in NGS-based DNA sequencing were used to amplify the individual target sequences for each guide RNA. The amplicons were sequenced on an Illumina MiSeq machine and analyzed with a proprietary Python script to measure gene editing (FIG. 22). The results indicated that the GPR146-H2 sgRNA was highly effective for editing in mouse hepatocytes.

Figure 23:
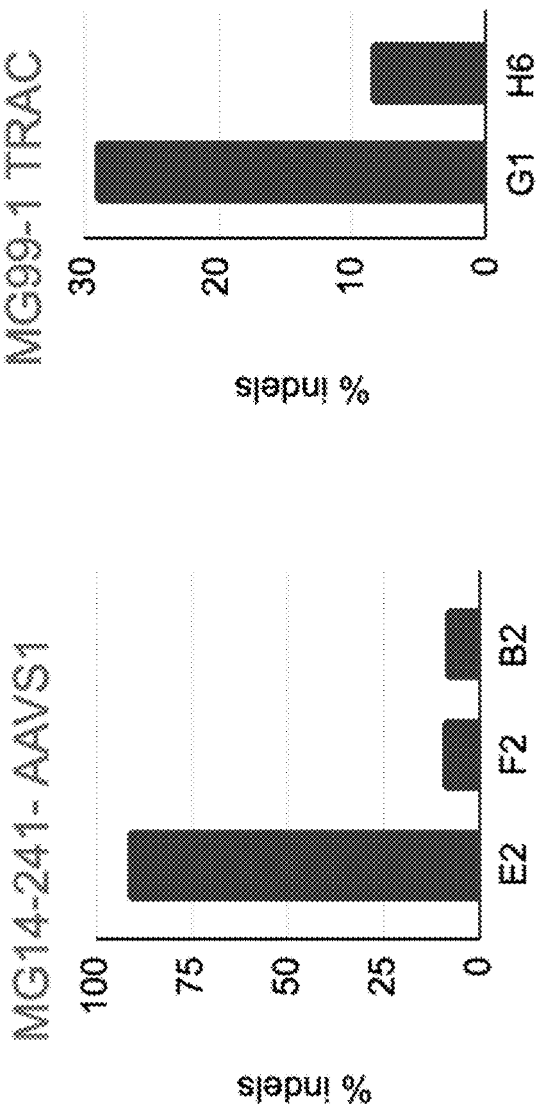
FIG. 23 depicts the gene editing outcomes at the DNA level for TRAC and AAVS1 in K562 cells.

Example 30—Gene Editing Outcomes at the DNA Level for TRAC and AAVS1 in K562 Cells Nucleofection of MG14-241 and MG99-1 mRNA along with the matching guide RNA (500 ng mRNA/150 pmol guide) was performed into 200,000 human lymphoblasts (K562 cells) using the Lonza 4D electroporator. Cells were harvested and genomic DNA prepared three days post-transfection. PCR primers appropriate for use in NGS-based DNA sequencing were generated, optimized, and used to amplify the individual target sequences for each guide RNA. The amplicons were sequenced on an Illumina MiSeq machine and analyzed with a proprietary Python script to measure gene editing. (FIG. 23).

TABLE 22

Guide RNAs and Sequences Targeted for Example 30

Figure 24:
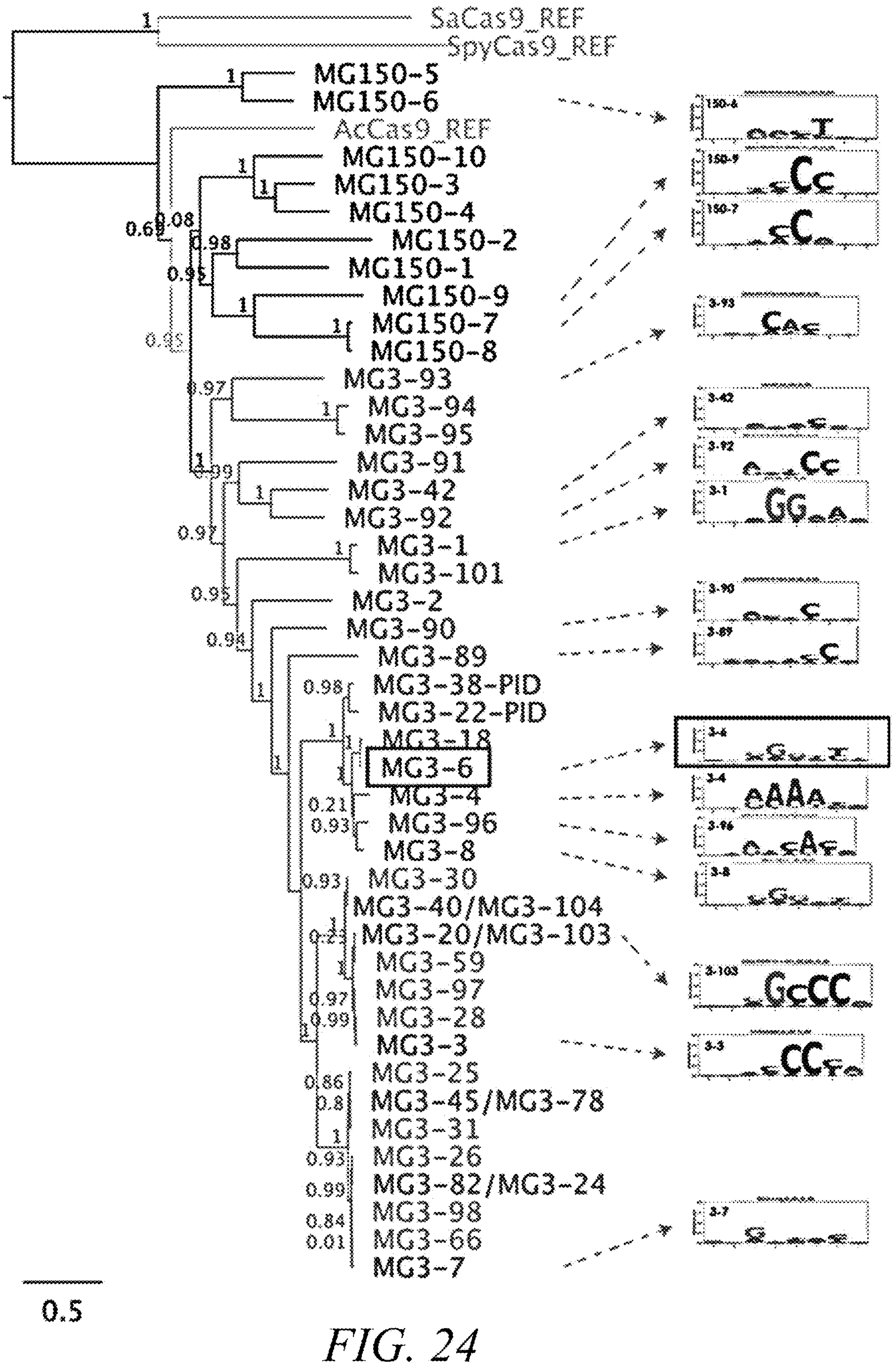
FIG. 24 depicts phylogenetic analysis of nucleases from the MG3 and MG150 families. PAM SeqLogo representations are shown for some active candidates. Reference SaCas9 and SpyCas9 sequences were included.
Figure 25:
FIG. 25 depicts phylogenetic analysis of nucleases from the MG15 family. Active candidates are highlighted with circles. Reference SaCas9, SpyCas9, and AcCas9 sequences were included as outgroup.
Figure 26:
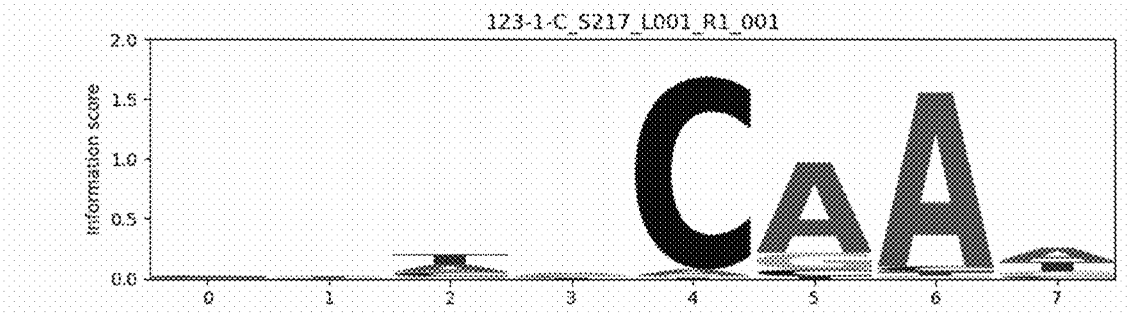
FIG. 26 depicts SeqLogos of the PAMs for MG123-1, MG124-2, MG 125-1 and MG125-2.
Figure 26:
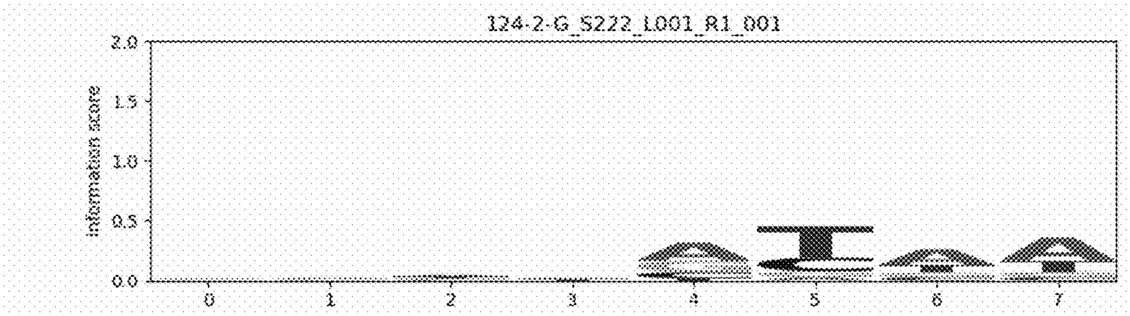
Figure 26:
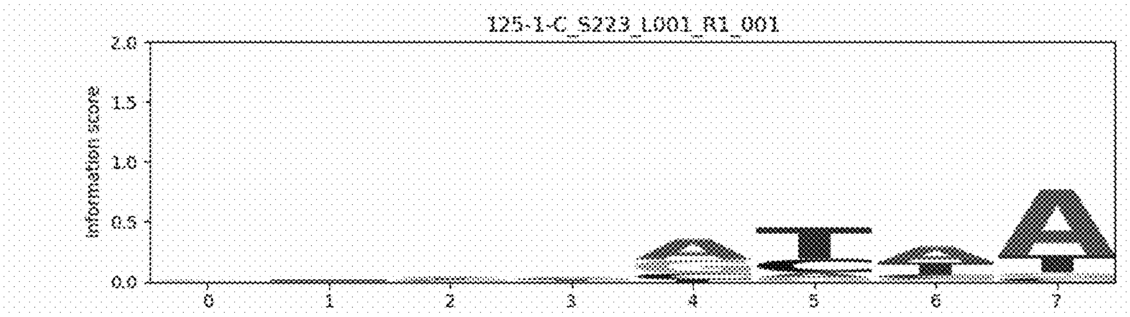
Figure 26:
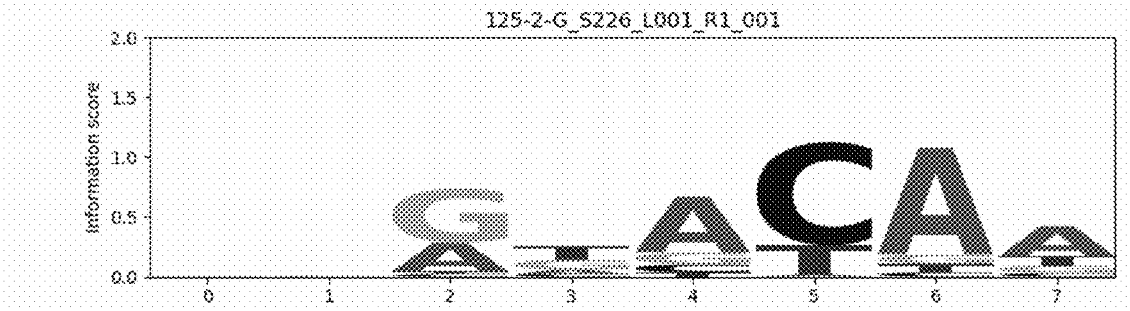
Figure 27:
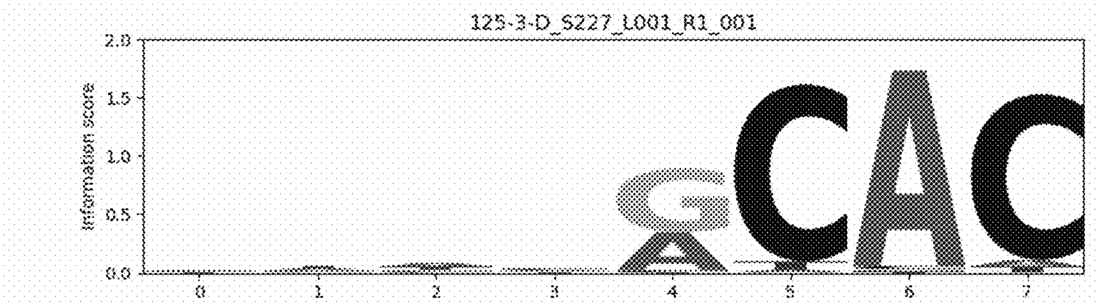
FIG. 27 depicts SeqLogos of the PAMs for MG125-3, MG125-4, MG125-5, and MG150-5.
Figure 27:
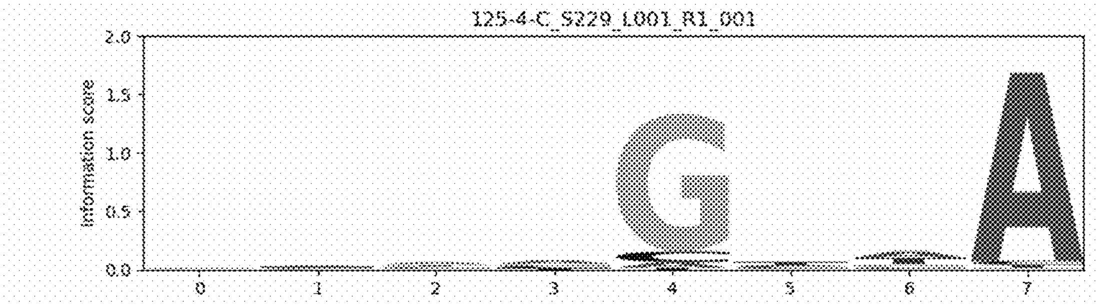
Figure 27:
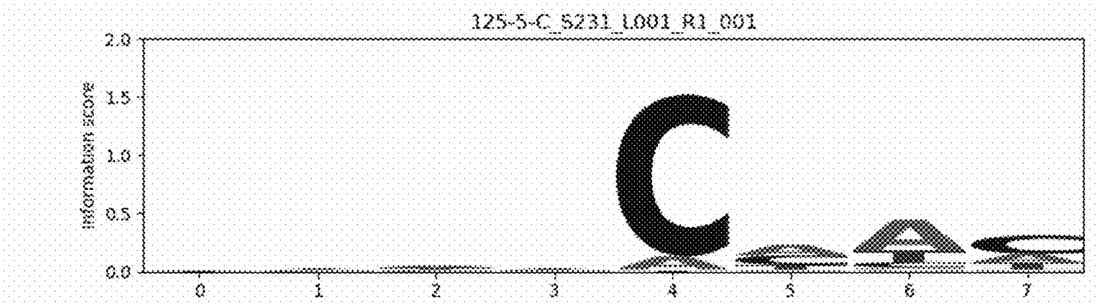
Figure 27:
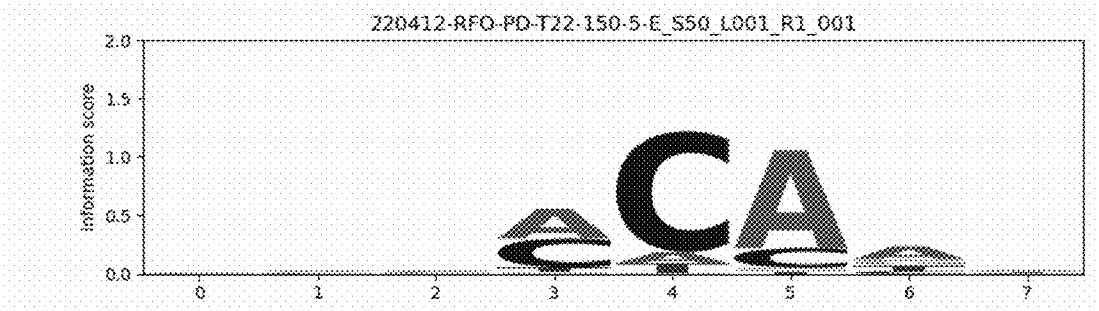
Figure 28:
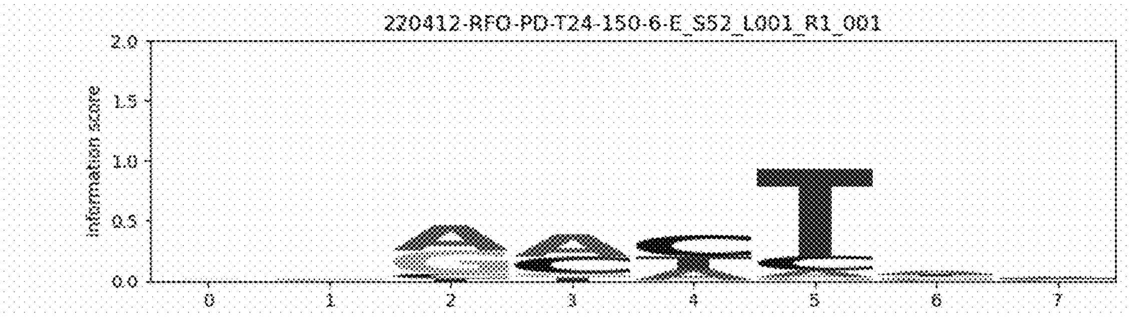
FIG. 28 depicts SeqLogos of the PAMs for MG150-6, MG150-7, MG150-8, and MG150-9.
Figure 28:
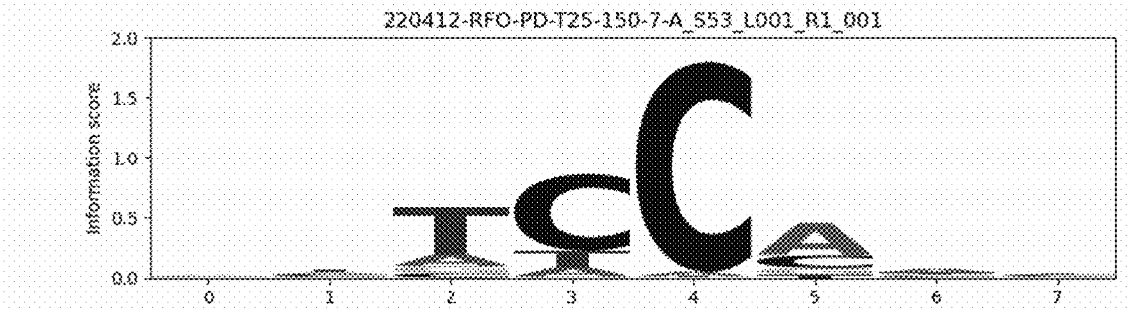
Figure 28:
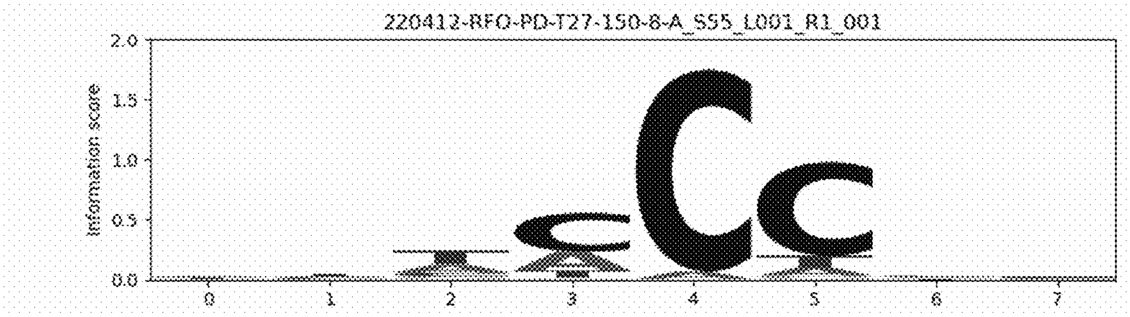
Figure 28:
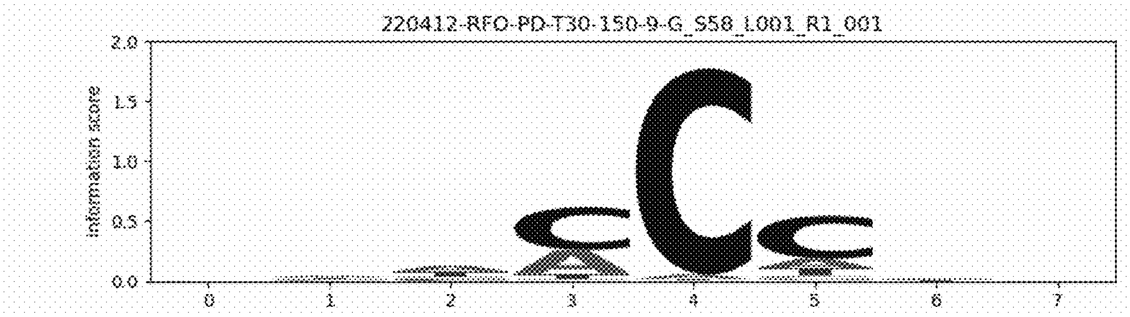
Figure 29:
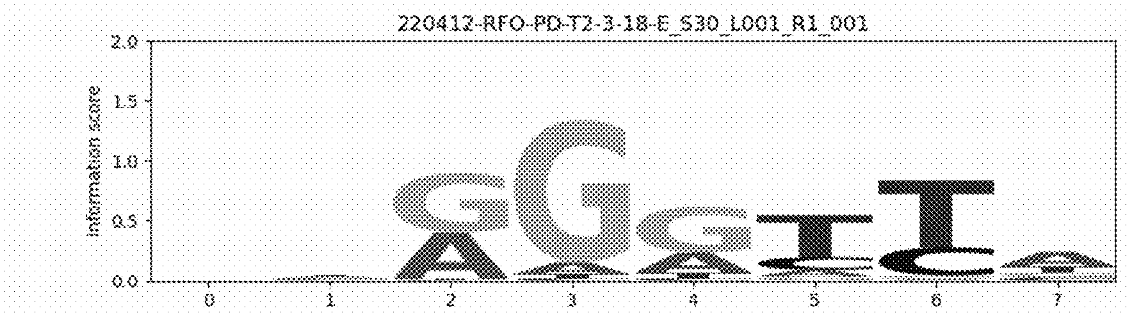
FIG. 29 depicts SeqLogos of the PAMs for MG3-18, MG3-89, MG3-90, and MG3-91.
Figure 29:
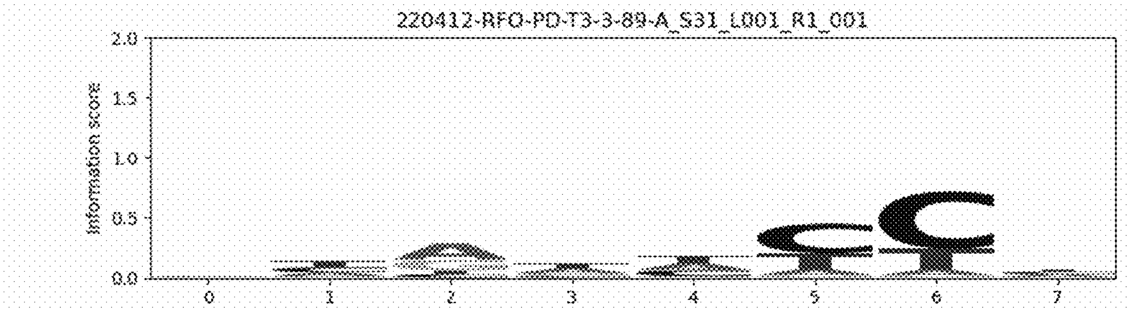
Figure 29:
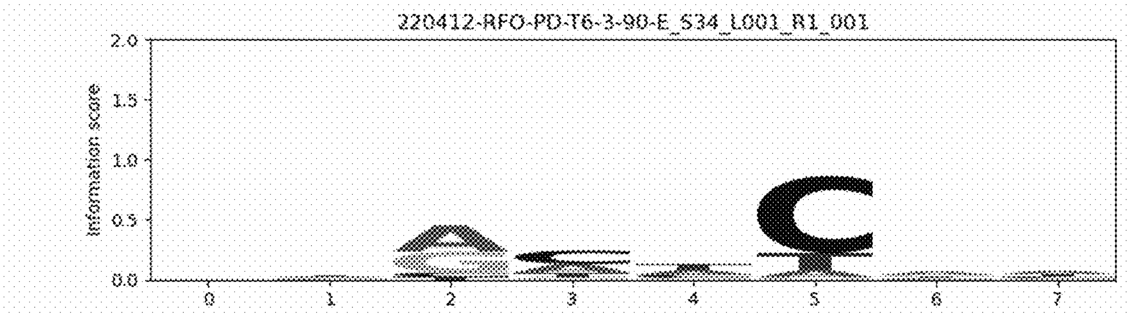
Figure 29:
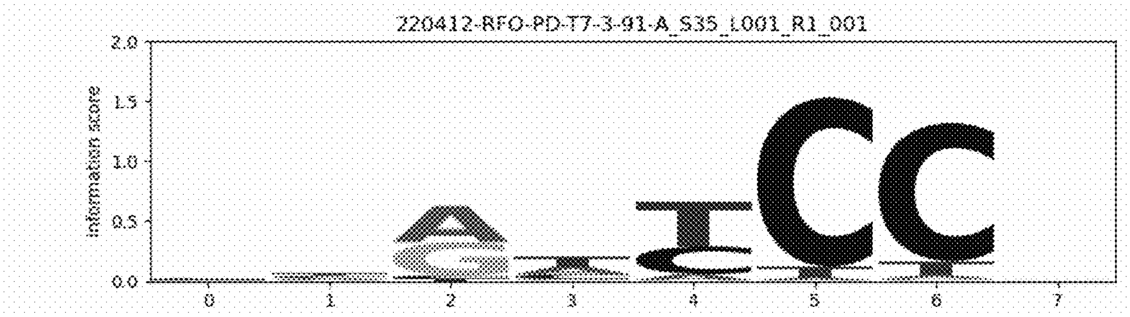
Figure 30:
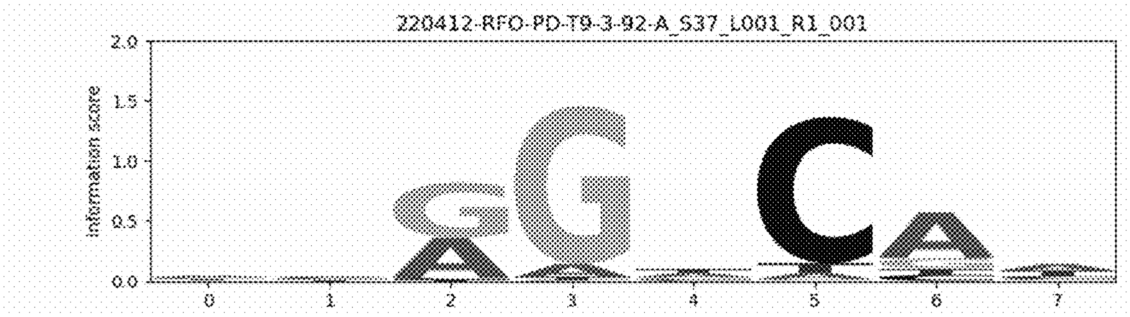
FIG. 30 depicts SeqLogos of the PAMs for MG3-92, MG3-93, MG3-95, and MG3-96.
Figure 30:
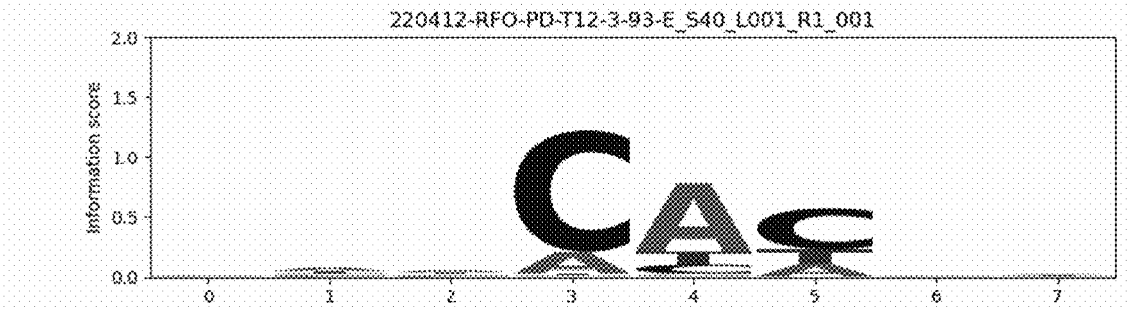
Figure 30:
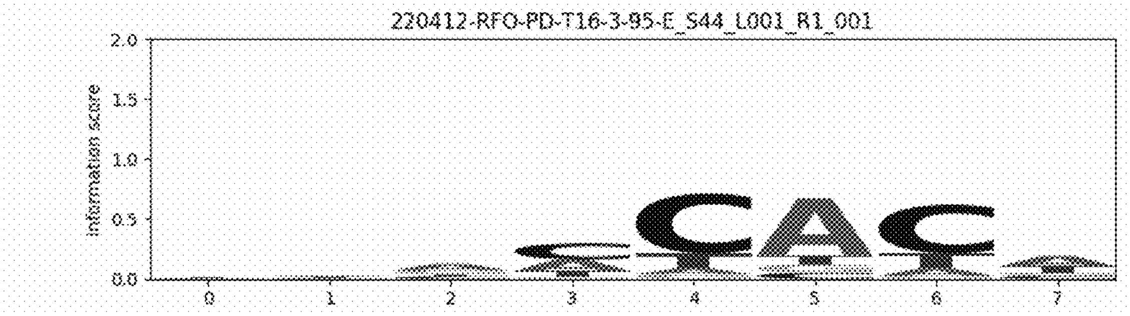
Figure 30:
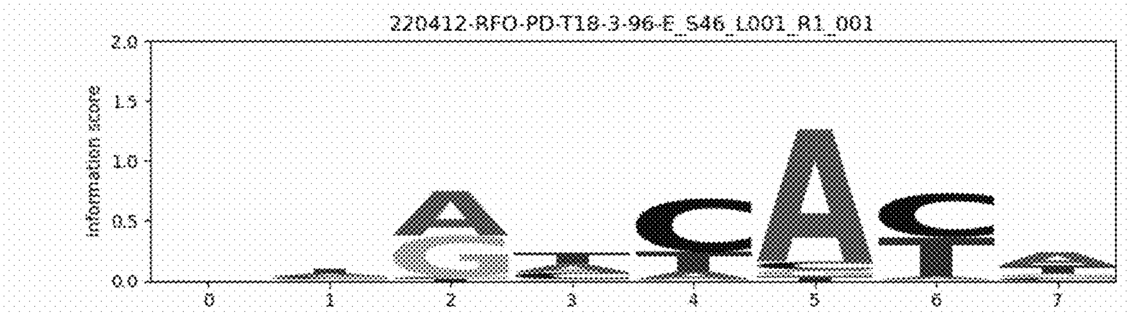
Figure 31:
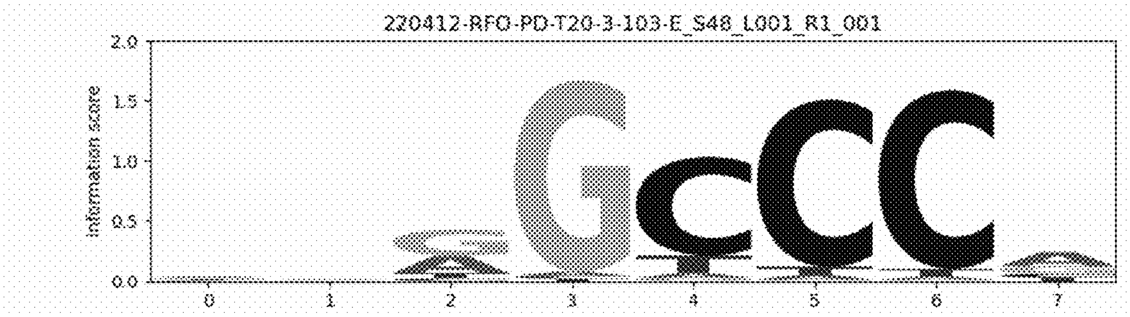
FIG. 31 depicts SeqLogos of the PAMs for MG3-103, MG15-130, MG15-146, and MG15-164.
Figure 31:
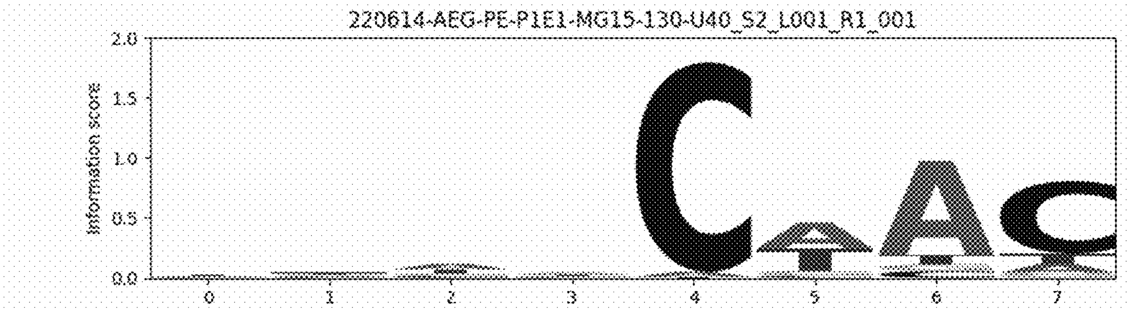
Figure 31:
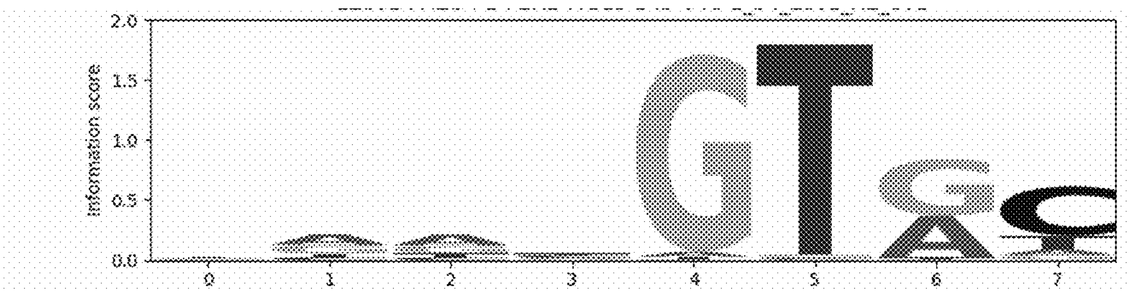
Figure 31:
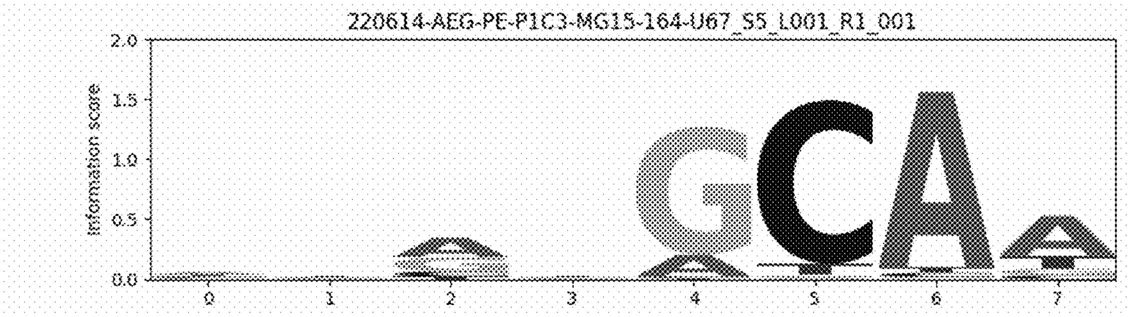
Figure 32:
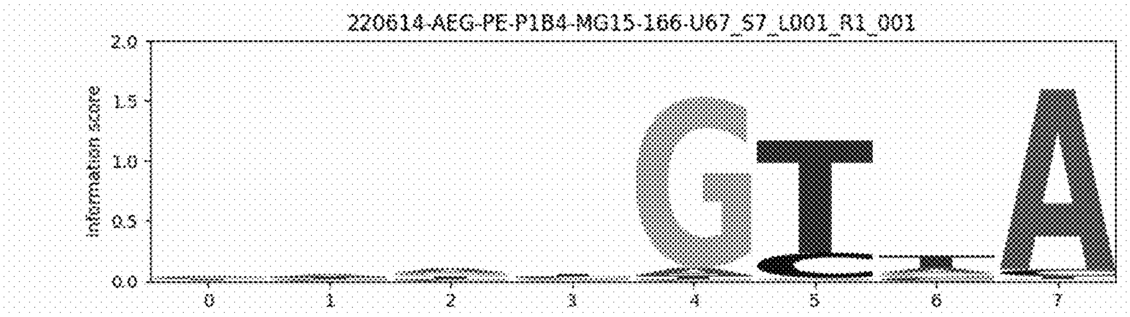
FIG. 32 depicts SeqLogos of the PAMs for MG15-166, MG15-171, MG15-172, and MG15-174.
Figure 32:
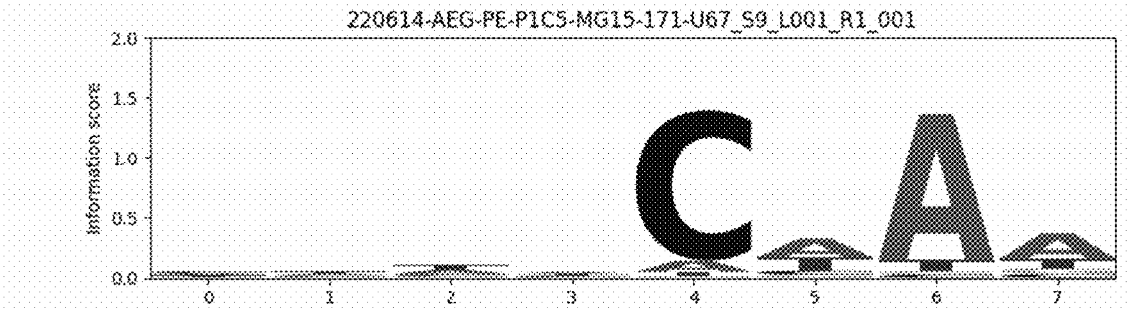
Figure 32:
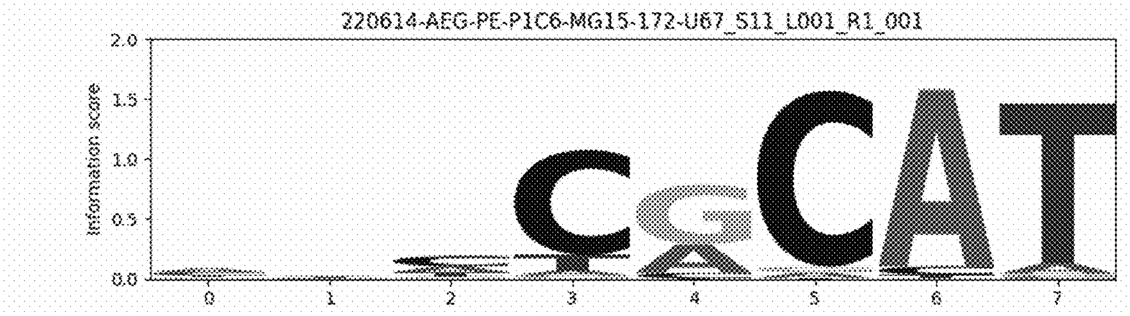
Figure 32:
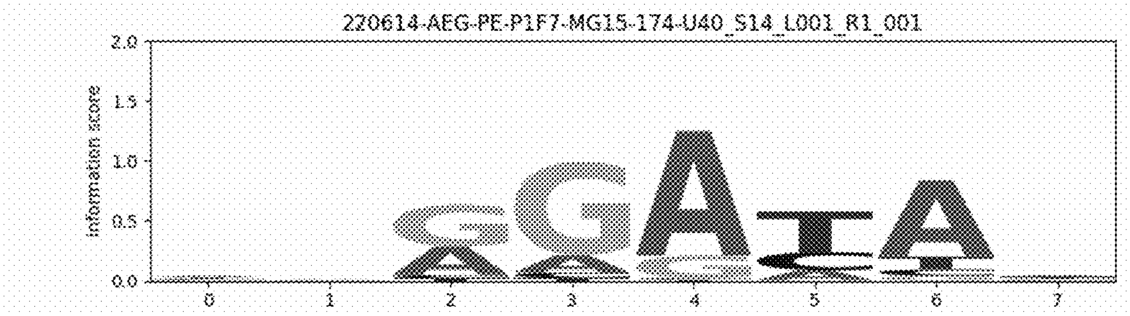
Figure 33:
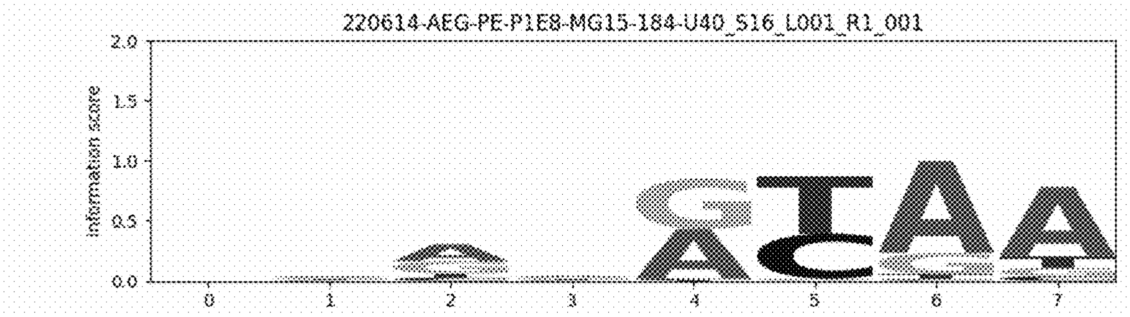
FIG. 33 depicts SeqLogos of the PAMs for MG15-184, MG15-187, MG15-191, and MG15-193.
Figure 33:
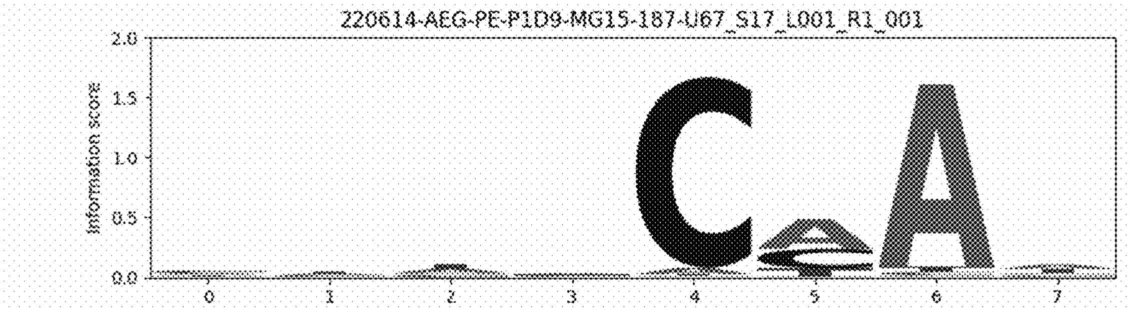
Figure 33:
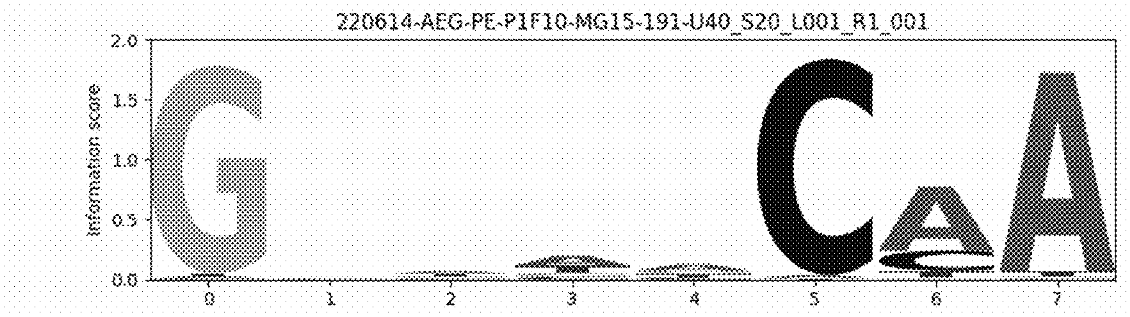
Figure 33:
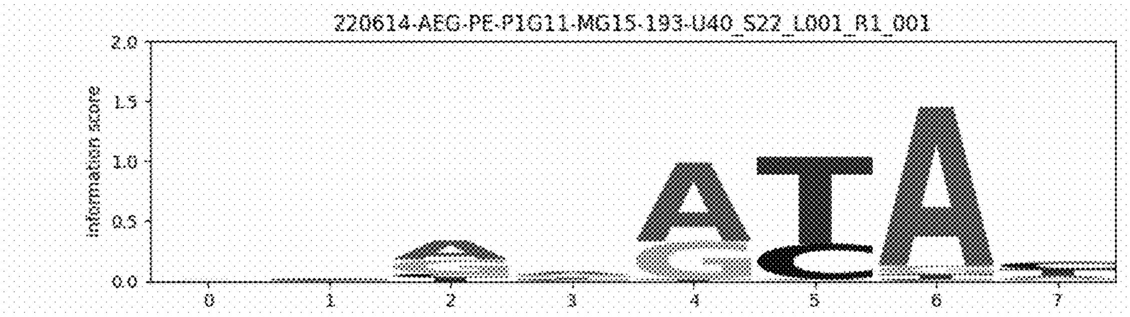
Figure 34:
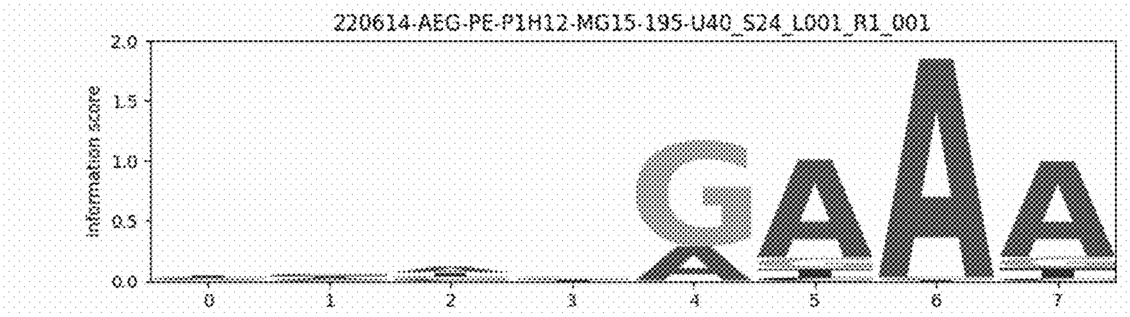
FIG. 34 depicts SeqLogos of the PAMs for MG15-195, MG15-217, MG15-218, and MG15-219.
Figure 34:
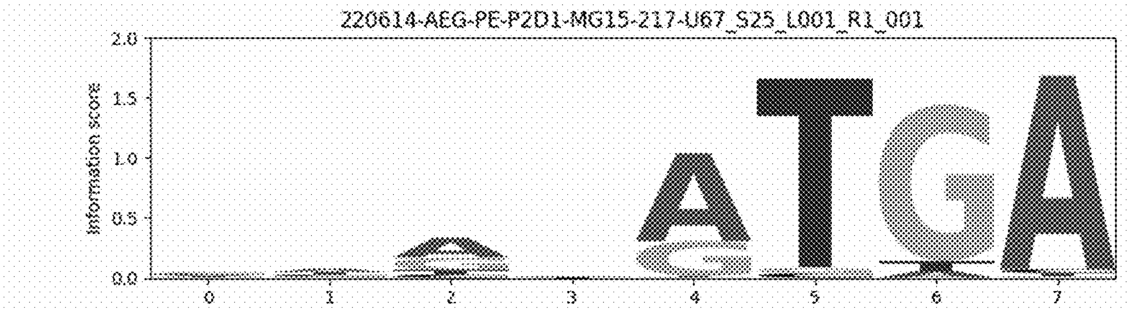
Figure 34:
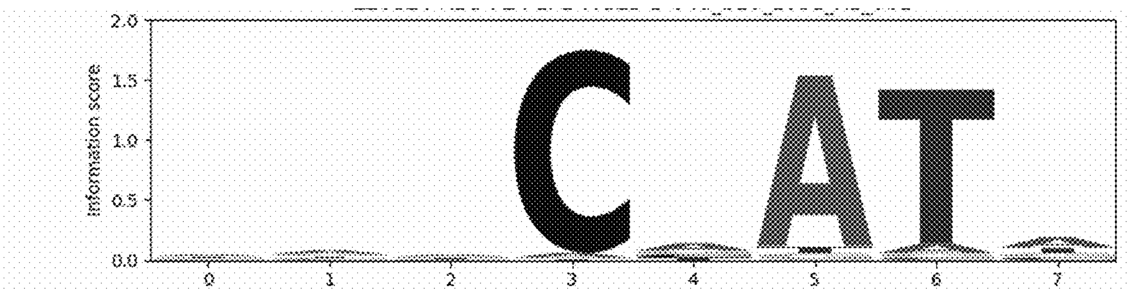
Figure 34:
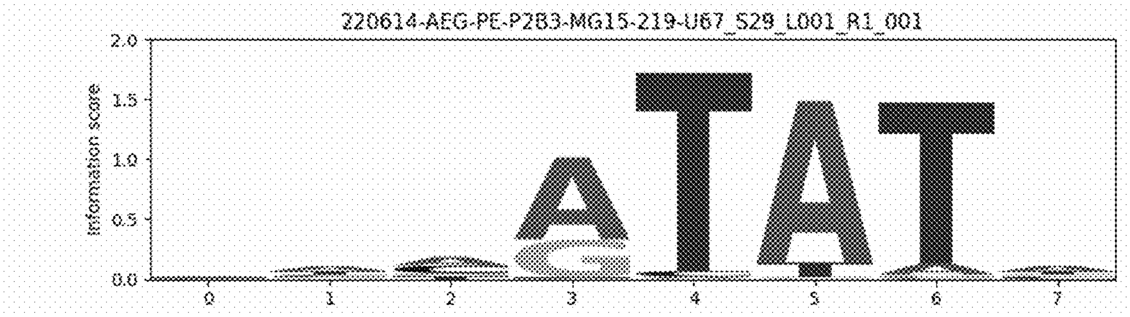
Figure 35:
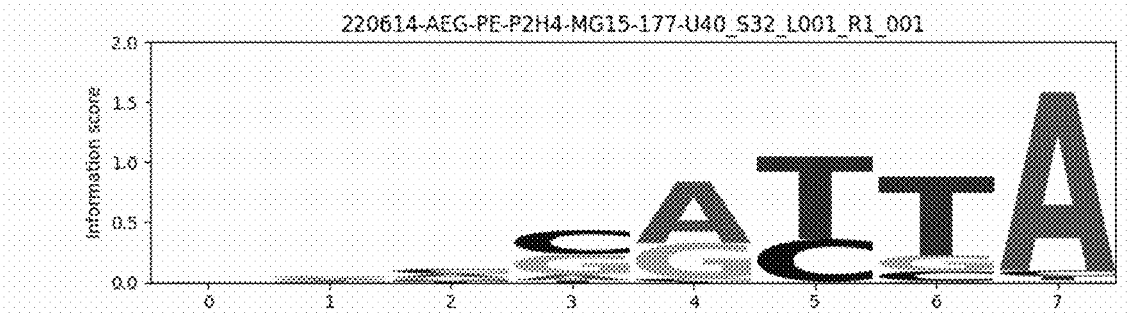
FIG. 35 depicts a SeqLogo of the PAM for MG15-177.

| SEQ ID NO: | NAME | SEQUENCE |
|---|---|---|
| 11508 | MG14-241-AAVS1-E2 | mU*mG*mG*rCrArCrArGrGrCrCrCrCrArGrArArGrGrArGrUrCrUrUrGrCrCrGrGrArArArCrGrGrCrUrArGrArCrArArGrGrGrArArUrCrGrCrUrUrUrUrArCrGrCrGrArUrUrArCrCrCrGrCrArArGrGrUrArArGrCrCrCrGrUrCrArGrCrArCrCrCrUrUrGrGrUrGrUrCrGrGrCrGrGrGrCrGrArUrCrCrUxmU*mU*mU |
| 11509 | MG14-241-AAVS1-F2 | mC*mC*mA*rCrUrArGrGrGrArCrArGrGrArUrUrGrGrUrGrUrCrUrUrGrCrCrGrGrArArArCrGrGrCrUrArGrArCrArArGrGrGrArArUrCrGrCrUrUrUrUrArCrGrCrGrArUrUrArCrCrCrGrCrArArGrGrUrArArGrCrCrCrGrUrCrArGrCrArCrCrCrUrUrGrGrUrGrUrCrGrGrCrGrGrGrCrGrArUrCrCrUxmU*mU*mU |
| 11510 | MG14-241-AAVS1-B2 | mA*mG*mG*rArGrArArCrGrGrGrGrUrGrUrCrCrArGrGrGrUrCrUrUrGrCrCrGrGrArArArCrGrGrCrUrArGrArCrArArGrGrGrArArUrCrGrCrUrUrUrUrArCrGrCrGrArUrUrArCrCrCrGrCrArArGrGrUrArArGrCrCrCrGrUrCrArGrCrArCrCrCrUrUrGrGrUrGrUrCrGrGrCrGrGrGrCrGrArUrCrCrUxmU*mU*mU |
| 11511 | MG14-241-AAVS1-E2 | TGGCACAGGCCCCAGAAGGA |
| 11512 | MG14-241-AAVS1-F2 | CCACTAGGGACAGGATTGGT |
| 11513 | MG14-241-AAVS1-B2 | AGGAGAACGGGGTGTCCAGG |
| 11514 | MG99-1-TRAC-G1 | mG*mA*mC*rArCrCrUrUrCrUrUrCrCrCrCrArGrCrCrCrArGrGrUrGrUrUrUrArGrUrUrCrUrCrUrGrArUrGrArArArArUrCrArGrUrArArGrUrUrCrUrArArArArUrArArGrGrCrArUrUrArUrGrCrCrGrUrGrGrGrGrUrArUrGrGrUrGrGrUrArUrCrCrUrCrGrUrUrCrArArArUrArUrCrCrArCrCrGrUrUrUrCrUrArArArArArArArUrCrGrCrGrCrGrCrCrGrCrCrGrGrCrGrUrGrCrU*mU*mU*mU |
| 11515 | MG99-1-TRAC-H6 | mC*mC*mC*rGrGrCrCrArCrUrUrUrCrArGrGrArGrGrArGrGrArUrGrUrUrUrArGrUrUrCrUrCrUrGrArUrGrArArArArUrCrArGrUrArArGrUrUrCrUrArArArArUrArArGrGrCrArUrUrArUrGrCrCrGrUrGrGrGrGrUrArUrGrGrUrGrGrUrArUrCrCrUrCrGrUrUrCrArArArUrArUrCrCrArCrCrGrUrUrUrCrUrArArArArArArArUrCrGrCrGrCrGrCrCrGrCrCrGrGrCrGrUrGrCrUxmU*mU*mU |
| 11516 | MG99-1-TRAC-G1 | GACACCTTCTTCCCCAGCCCAGGT |
| 11517 | MG99-1-TRAC-H6 | CCCGGCCACTTTCAGGAGGAGGAT |

r = native ribose base, m = 2'-O methyl modified base, F = 2' Fluro modified base, * = phosphorothioate bond Example 31—Novel Type II CRISPR Effectors are Active Nucleases with Diverse PAM Requirements Novel nucleases of the MG3, MG15, MG150, MG123, MG124, and MG125 families were identified from phylogenetic analysis. The MG150 family of nucleases is more closely related to the MG3 family than to any other family identified (FIG. 24), and a new group of divergent effectors expanded the MG15 family of nucleases (FIG. 25). In vitro cleavage activity assays show that nucleases reported here generally have preference for cleavage at positions three or four from the PAM (Table 23). In addition, PAM sequence determination for Type II nucleases indicates diverse PAM requirements, as shown by the SeqLogo images from NGS data. (FIGS. 26-35)

TABLE 23

Cut sites of MG Family Variants

| Candidate | Cut Site from NGS | Candidate | Cut Site from NGS |
|---|---|---|---|
| MG1-2 (SEQ ID NO: 6) | 3 | MG71-2 | 2 or 3 |
| MG1-4 (SEQ ID NO: 1) | 4 | MG72-1 | 3 |
| MG1-5 (SEQ ID NO: 2) | 4 | MG73-1 (SEQ ID NO: 11720) | 3 |
| MG1-6 (SEQ ID NO: 3) | 4 | MG73-2 (SEQ ID NO: 11721) | 3 |
| MG1-7 (SEQ ID NO: 4) | 4 | MG74-1 (SEQ ID NO: 11722) | 3 |
| MG14-1 (SEQ ID NO: 678) | 1 or 3 | MG86-1 (SEQ ID NO: 11723) | 3 |
| MG14-241 (SEQ ID NO: 914) | 3 | MG86-2 (SEQ ID NO: 11724) | 3 |
| MG14-244 (SEQ ID NO:917) | 3 | MG87-1 (SEQ ID NO: 11725) | 3 |
| MG14-246 (SEQ ID NO: 919) | 3 | MG87-2 (SEQ ID NO: 11726) | 3 |
| MG14-248 (SEQ ID NO: 921) | 3 | MG87-3 (SEQ ID NO: 11727) | 3 |
| MG14-5 (SEQ ID NO: 681) | 3 | MG88-1 (SEQ ID NO: 11728) | 3 |
| MG15-1 (SEQ ID NO: 930) | 1 or 3 | MG88-2 (SEQ ID NO: 11729) | 3 |
| MG15-115 (SEQ ID NO: 1042) | 3 | MG88-3 (SEQ ID NO: 11730) | 3 |
| MG15-135 (SEQ ID NO: 1062) | 3 | MG89-2 (SEQ ID NO: 11731) | 3 |
| MG15-54 (SEQ ID NO: 981) | 3 | MG89-3 (SEQ ID NO: 11732) | 3 |
| MG15-66 (SEQ ID NO: 993) | 3 | MG94-1 (SEQ ID NO: 11733) | 3 |
| MG15-94 (SEQ ID NO: 1021) | 3 | MG94-2 (SEQ ID NO: 8748) | 3 |
| MG16-1 (SEQ ID NO: 11718) | 1 or 3 | MG95-1 (SEQ ID NO: 8782) | 3 |
| MG16-2 (SEQ ID NO: 1093) | 3 | MG95-2 (SEQ ID NO: 8783) | 3 |
| MG16-3 (SEQ ID NO: 11734) | 3 | MG96-1 (SEQ ID NO: 8786) | 3 |

TABLE 23-continued

| Cut sites of MG Family Variants | | | |
|---|---|---|---|
| Candidate | Cut Site from NGS | Candidate | Cut Site from NGS |
| MG17-2 (SEQ ID NO: 7700) | 3 | MG98-1 (SEQ ID NO: 8819) | 3 |
| MG18-1 (SEQ ID NO: 1354) | 1 or 3 | MG98-2 (SEQ ID NO: 8820) | 3 |
| MG2-4 (SEQ ID NO: 11735) | 1 or 3 | MG99-1 (SEQ ID NO: 11748) | 3 |
| MG2-5 (SEQ ID NO: 323) | 3 | MG100-1 (SEQ ID NO: 8960) | 3 |
| MG2-55 (SEQ ID NO: 371) | 3 | MG100-2 (SEQ ID NO: 8961) | 3 |
| MG2-7 (SEQ ID NO: 321) | 3 | MG111-1 (SEQ ID NO: 9037) | 3 |
| MG21-1 (SEQ ID NO: 1512) | 1 or 3 | MG111-2 (SEQ ID NO: 9038) | 3 |
| MG21-2 (SEQ ID NO: 11736) | 3 | MG112-3 (SEQ ID NO: 11749) | 3 |
| MG21-3 (SEQ ID NO: 1513( | 3 | MG116-1 (SEQ ID NO: 9150) | 3 |
| MG21-97 (SEQ ID NO: 1607) | 3 | MG123-1 (SEQ ID NO: 11750) | 3 |
| MG22-1 (SEQ ID NO: 1656) | 1 or 3 | MG124-2 (SEQ ID NO: 11751) | 3 |
| MG22-2 (SEQ ID NO: 11737) | 3 | MG125-1 (SEQ ID NO: 11752) | 3 |
| MG22-3 (SEQ ID NO: 1657) | 3 | MG125-2 (SEQ ID NO: 11753) | 3 |
| MG23-1 (SEQ ID NO: 1756) | 3 | MG125-3 (SEQ ID NO: 11754) | 3 |
| MG23-2 (SEQ ID NO: 11738) | 3 | MG125-4 (SEQ ID NO: 11755) | 3 |
| MG23-3 (SEQ ID NO: 1757) | 3 | MG125-5 (SEQ ID NO: 11756) | 3 |
| MG3-1_long (SEQ ID NO: 424) | 3 | MG150-5 (SEQ ID NO: 7363) | 3 |
| MG3-3 (SEQ ID NO: 11739) | 3 | MG150-6 (SEQ ID NO: 7364) | 3 |
| MG3-4 (SEQ ID NO: 11740) | 3 | MG150-7 (SEQ ID NO: 7365) | 3 |
| MG3-42 (SEQ ID NO: 429) | 3 or 4 | MG150-8 (SEQ ID NO: 7366) | 3 |
| MG3-6 (SEQ ID NO: 426) | 3 | MG150-9 (SEQ ID NO: 7367) | 3 |
| MG3-7 (SEQ ID NO: 422) | 3 | MG3-18 (SEQ ID NO: 11757) | 3 |
| MG3-8 (SEQ ID NO: 428) | 3 | MG3-89 (SEQ ID NO: 11758) | 3 |
| MG4-2 (SEQ ID NO: 11741) | 2 or 3 | MG3-90 (SEQ ID NO: 11759) | 3 |
| MG4-5 (SEQ ID NO: 432) | 1 or 3 | MG3-91 (SEQ ID NO: 11760) | 3 |

TABLE 23-continued

| Cut sites of MG Family Variants | | | |
|---|---|---|---|
| Candidate | Cut Site from NGS | Candidate | Cut Site from NGS |
| MG40-1 (SEQ ID NO: 5718) | 3 | MG3-92 (SEQ ID NO: 11761) | 3 |
| MG40-2 (SEQ ID NO: 5719) | 3 | MG3-93 (SEQ ID NO: 11762) | 3 |
| MG40-3 (SEQ ID NO: 5720) | 3 | MG3-95 (SEQ ID NO: 11763) | 3 |
| MG40-4 (SEQ ID NO: 5721) | 3 | MG3-96 (SEQ ID NO: 11764) | 3 |
| MG40-5(SEQ ID NO: 5722) | 3 | MG3-103 (SEQ ID NO: 11765) | 3 |
| MG40-6 (SEQ ID NO: 5723) | 3 | MG15-130 (SEQ ID NO: 1057) | 3 |
| MG43-3 (SEQ ID NO: 8359) | 3 | MG15-146 (SEQ ID NO: 1073) | 3 |
| MG44-1 (SEQ ID NO: 11742) | 3 | MG15-164 (SEQ ID NO: 1091) | 3 |
| MG46-1 (SEQ ID NO: 11743) | 3 | MG15-166 (SEQ ID NO: 11766) | 3 |
| MG47-1 (SEQ ID NO: 5751) | 3 | MG15-171 (SEQ ID NO: 7605) | 3 |
| MG47-2 (SEQ ID NO: 5752) | 3 | MG15-172 (SEQ ID NO: 7606) | 3 |
| MG48-1 (SEQ ID NO: 5769) | 3 | MG15-174 (SEQ ID NO: 7608) | 3 |
| MG48-3 (SEQ ID NO: 5771) | 3 | MG15-184 (SEQ ID NO: 7618) | 3 |
| MG49-1 (SEQ ID NO: 5805) | 3 | MG15-187 (SEQ ID NO: 7621) | 3 |
| MG49-2 (SEQ ID NO: 5806) | 3 | MG15-191 (SEQ ID NO: 11767) | 2 |
| MG50-1 (SEQ ID NO: 5824) | 3 | MG15-193 (SEQ ID NO: 11768) | 3 |
| MG51-1 (SEQ ID NO: 5827) | 3 | MG15-195 (SEQ ID NO: 11769) | 3 |
| MG52-1 (SEQ ID NO: 5831) | 2 | MG15-217 (SEQ ID NO: 11770) | 3 |
| MG6-3 (SEQ ID NO: 11744) | 1 | MG15-218 (SEQ ID NO: 11771) | 4 |
| MG6-5 (SEQ ID NO: 11745) | 3 | MG15-219 (SEQ ID NO: 11772) | 4 |
| MG7-1 (SEQ ID NO: 11746) | 3 | MG15-177 (SEQ ID NO: 7611) | 3 |
| MG71-1 (SEQ ID NO: 11747) | 3 | | |

Embodiments

The following embodiments are illustrative in nature and are not intended to be limiting in any way:

1. A method of editing a B2M locus in a cell, comprising contacting to said cell
   (a) an RNA-guided endonuclease; and
   (b) an engineered guide RNA, wherein said engineered guide RNA is configured to form a complex with said endonuclease and said engineered guide RNA comprises a spacer sequence configured to hybridize to a region of said B2M locus,
      wherein said region of said B2M locus comprises a targeting sequence having at least 85% identity to at least 18 consecutive nucleotides of any one of SEQ ID NOs: 6387-6468.
2. The method of embodiment 1, wherein said RNA-guided endonuclease is a class 2, type II Cas endonuclease.
3. The method of embodiment 1, wherein said RNA-guided endonuclease comprises a RuvCIII domain comprising a sequence having at least 75% sequence identity to SEQ ID NO: 2242 or SEQ ID NO: 2244.
4. The method of embodiment 3, wherein said RNA-guided endonuclease further comprises an HNH domain.
5. The method of embodiment 1, wherein said engineered guide RNA comprises a sequence having at least 80% identity to any one of SEQ ID NOs: 6305-6386.
6. The method of embodiment 1, wherein said region of said B2M locus comprises a sequence at least 75%, 80%, or 90% identical to at least 19 of the non-degenerate nucleotides of any one of SEQ ID NOs: 6388, 6399, 6401, 6403, 6410, 6413, 6421, 6446, and 6448.
7. A method of editing a TRAC locus in a cell, comprising contacting to said cell
   (a) an RNA-guided endonuclease; and
   (b) an engineered guide RNA, wherein said engineered guide RNA is configured to form a complex with said endonuclease and said engineered guide RNA comprises a spacer sequence configured to hybridize to a region of said TRAC locus,
      wherein said region of said TRAC locus comprises a targeting sequence having at least 85% identity to at least 18 consecutive nucleotides of any one of SEQ ID NOs: 6509-6548.
8. The method of embodiment 7, wherein said RNA-guided endonuclease is a class 2, type II Cas endonuclease.
9. The method of embodiment 7, wherein said RNA-guided endonuclease comprises a RuvCIII domain comprising a sequence having at least 75% sequence identity to SEQ ID NO: 2242 or SEQ ID NO: 2244.
10. The method of embodiment 9, wherein said RNA-guided endonuclease further comprises an HNH domain.
11. The method of embodiment 7, wherein said engineered guide RNA comprises a sequence having at least 80% identity to any one of SEQ ID NOs: 6469-6508.
12. The method of embodiment 7, wherein said region of said TRAC locus comprises a sequence at least 75%, 80%, or 90% identical to at least 19 of the non-degenerate nucleotides of any one of SEQ ID NOs: 6517, 6520, and 6523.
13. A method of editing a HPRT locus in a cell, comprising contacting to said cell
   (a) an RNA-guided endonuclease; and
   (b) an engineered guide RNA, wherein said engineered guide RNA is configured to form a complex with said endonuclease and said engineered guide RNA comprises a spacer sequence configured to hybridize to a region of said HPRT locus,
      wherein said region of said HPRT locus comprises a targeting sequence having at least 85% identity to at least 18 consecutive nucleotides of any one of SEQ ID NOs: 6616-6682.
14. The method of embodiment 13, wherein said RNA-guided endonuclease is a class 2, type II Cas endonuclease.
15. The method of embodiment 13, wherein said RNA-guided endonuclease comprises a RuvCIII domain comprising a sequence having at least 75% sequence identity to SEQ ID NO: 2242 or SEQ ID NO: 2244.
16. The method of embodiment 15, wherein said RNA-guided endonuclease further comprises an HNH domain.
17. The method of embodiment 13, wherein said engineered guide RNA comprises a sequence having at least 80% identity to any one of SEQ ID NOs: 6549-6615.
18. The method of embodiment 13, wherein said region of said HPRT locus comprises a sequence at least 75%, 80%, or 90% identical to at least 19 of the non-degenerate nucleotides of any one of SEQ ID NOs: 6619, 6634, 6673, 6675, and 6679.
19. A method of editing a TRBC1/2 locus in a cell, comprising contacting to said cell
   (a) an RNA-guided endonuclease; and
   (b) an engineered guide RNA, wherein said engineered guide RNA is configured to form a complex with said endonuclease and said engineered guide RNA comprises a spacer sequence configured to hybridize to a region of said TRBC1/2 locus,
      wherein said region of said TRBC1/2 locus comprises a targeting sequence having at least 85% identity to at least 18 consecutive nucleotides of any one of SEQ ID NOs: 6722-6760 or 6782-6802.
20. The method of embodiment 19, wherein said RNA-guided endonuclease is a class 2, type II Cas endonuclease.
21. The method of embodiment 19, wherein said RNA-guided endonuclease comprises a RuvCIII domain comprising a sequence having at least 75% sequence identity to SEQ ID NO: 2242 or SEQ ID NO: 2244.
22. The method of embodiment 21, wherein said RNA-guided endonuclease further comprises an HNH domain.
23. The method of embodiment 19, wherein said engineered guide RNA comprises a sequence having at least 80% identity to any one of SEQ ID NOs: 6683-6721 and 6761-6781.
24. The method of embodiment 19, wherein said region of said TRBC1/2 locus comprises a sequence at least 75%, 80%, or 90% identical to at least 19 of the non-degenerate nucleotides of any one of SEQ ID NOs: 6734, 6753, 6790, and 6800.
25. A method of editing a HAO1 locus in a cell, comprising contacting to said cell
   (a) an RNA-guided endonuclease; and
   (b) an engineered guide RNA, wherein said engineered guide RNA is configured to form a complex with said endonuclease and said engineered guide RNA comprises a spacer sequence configured to hybridize to a region of said HAO1 locus, wherein said region of said HAO1 locus comprises a targeting sequence having at least 85% identity to at least 18 consecutive nucleotides of any one of SEQ ID NOs: 11802-11820.

26. The method of embodiment 25, wherein said RNA-guided endonuclease is a class 2, type II Cas endonuclease.

27. The method of embodiment 25, wherein said RNA-guided endonuclease comprises a RuvCIII domain comprising a sequence having at least 75% sequence identity to SEQ ID NO: 2242.

28. The method of embodiment 27, wherein said RNA-guided endonuclease further comprises an HNH domain.

29. The method of embodiment 25, wherein said region of said HAO1 locus comprises a sequence at least 75%, 80%, or 90% identical to at least 19 of the non-degenerate nucleotides of any one of SEQ ID NOs: 11806, 11813, 11816, and 11819.

30. The method of embodiment 1 wherein said RNA-guided endonuclease is a Cas endonuclease.

31. The method of embodiment 2, wherein said class 2, type II Cas endonuclease comprises an endonuclease having at least 75% sequence identity to any one of SEQ ID NOs: 421-431.

32. The method of any one of embodiments 1-4, 30-31, wherein said RNA-guided endonuclease comprises a sequence at least 75%, 80%, or 90% identical to SEQ ID NO: 421.

33. The method of any one of embodiments 1-4, 30-32, wherein said engineered guide RNA comprises a sequence having at least 80% identity to any one of SEQ ID NOs: 6305-6386.

34. The method of any one of embodiments 1-4, 30-32, wherein said engineered guide RNA comprises a sequence at 80%, or at least 90% identical to any one of SEQ ID NOs: 6306, 6317, 6319, 6321, 6328, 6331, 6339, 6364, and 6366.

35. The method of embodiment 7, wherein said RNA-guided endonuclease is a Cas endonuclease.

36. The method of embodiment 8, wherein said class 2, type II Cas endonuclease comprises an endonuclease having at least 75% sequence identity to any one of SEQ ID NOs: 421-431.

37. The method of any one of embodiments 7-10, 35-36, wherein said RNA-guided endonuclease comprises a sequence at least 75%, 80%, or 90% identical to SEQ ID NO: 421.

38. The method of any one of embodiments 7-10, 35-37, wherein said engineered guide RNA comprises a sequence at 80%, or at least 90% identical to any one of SEQ ID NOs: 6477, 6480, and 6483.

39. The method of embodiment 13, wherein said RNA-guided endonuclease is a Cas endonuclease.

40. The method of embodiment 14, wherein said class 2, type II Cas endonuclease comprises an endonuclease having at least 75% sequence identity to any one of SEQ ID NOs: 421-431.

41. The method of any one of embodiments 13-16, 39-40, wherein said RNA-guided endonuclease comprises a sequence at least 75%, 80%, or 90% identical to SEQ ID NO: 421 or SEQ ID NO: 423.

42. The method of any one of embodiments 13-16, 39-40, wherein said engineered guide RNA comprises a sequence at 80%, or at least 90% identical to any one of SEQ ID NOs: 6552, 6567, 6606, 6608, and 6612.

43. The method of embodiment 19, wherein said RNA-guided endonuclease is a Cas endonuclease.

44. The method of embodiment 20, wherein said class 2, type II Cas endonuclease comprises an endonuclease having at least 75% sequence identity to any one of SEQ ID NOs: 421-431.

45. The method of any one of embodiments 19-22, 43-44, wherein said RNA-guided endonuclease comprises a sequence at least 75%, 80%, or 90% identical to SEQ ID NO: 421 or SEQ ID NO: 423.

46. The method of any one of embodiments 19-22, 43-45, wherein said engineered guide RNA comprises a sequence at 80%, or at least 90% identical to any one of SEQ ID NOs: 6695, 6714, 6769, and 6779.

47. The method of embodiment 25, wherein said RNA-guided endonuclease is a Cas endonuclease.

48. The method of embodiment 26, wherein said class 2, type II Cas endonuclease comprises an endonuclease having at least 75% sequence identity to any one of SEQ ID NOs: 421-431.

49. The method of any one of embodiments 25-28, 47-48, wherein said RNA-guided endonuclease comprises a sequence at least 75%, 80%, or 90% identical to SEQ ID NO: 421.

50. The method of any one of embodiments 1-24, 30-46, wherein said cell is a peripheral blood mononuclear cell (PBMC).

51. The method of any one of embodiments 1-24, 30-46, wherein said cell is a T-cell or a precursor thereof or a hematopoietic stem cell (HSC).

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

TABLE 24

Listing of additional protein and nucleic acid sequences referred to herein not included in the sequence listing

| Category | SEQ ID: | Description | Type | Organism | Sequence |
|---|---|---|---|---|---|
| MG123 active effectors PAM | 11518 | MG123-1 3' PAM | Nucleotide | artificial sequence | nnnnCAAa |
| MG124 active effectors PAM | 11519 | MG124-2 3' PAM | Nucleotide | artificial sequence | nnnnATAA |
| MG125 active effectors PAM | 11520 | MG125-1 3' PAM | Nucleotide | artificial sequence | nnnnATAA |
| MG125 active effectors PAM | 11521 | MG125-2 3' PAM | Nucleotide | artificial sequence | nnGTACAA |
| MG125 active effectors PAM | 11522 | MG125-3 3' PAM | Nucleotide | artificial sequence | nnnnRCAC |
| MG125 active effectors PAM | 11523 | MG125-4 3' PAM | Nucleotide | artificial sequence | nnnnGnnA |
| MG125 active effectors PAM | 11524 | MG125-5 3' PAM | Nucleotide | artificial sequence | nnnnCnnn |
| MG150 active effectors PAM | 11525 | MG150-5 3' PAM | Nucleotide | artificial sequence | nnnMCMnn |
| MG150 active effectors PAM | 11526 | MG150-6 3' PAM | Nucleotide | artificial sequence | nnRMYTnn |
| MG150 active effectors PAM | 11527 | MG150-7 3' PAM | Nucleotide | artificial sequence | nnwMCrnn |
| MG150 active effectors PAM | 11528 | MG150-8 3' PAM | Nucleotide | artificial sequence | nnwMCCnn |
| MG150 active effectors PAM | 11529 | MG150-9 3' PAM | Nucleotide | artificial sequence | nnnMCMnn |
| MG3 active effectors PAM | 11530 | MG3-18 3' PAM | Nucleotide | artificial sequence | nnRGGTY |
| MG3 active effectors PAM | 11531 | MG3-89 3' PAM | Nucleotide | artificial sequence | nnRwwYYn |
| MG3 active effectors PAM | 11532 | MG3-90 3' PAM | Nucleotide | artificial sequence | nnRmwYnn |

TABLE 24-continued

Listing of additional protein and nucleic acid sequences referred to herein not included in the sequence listing

| Category | SEQ ID: | Description | Type | Organism | Sequence |
|---|---|---|---|---|---|
| MG3 active effectors PAM | 11533 | MG3-91 3' PAM | Nucleotide | artificial sequence | nnRwYCCn |
| MG3 active effectors PAM | 11534 | MG3-92 3' PAM | Nucleotide | artificial sequence | nnRGnCAn |
| MG3 active effectors PAM | 11535 | MG3-93 3' PAM | Nucleotide | artificial sequence | nnCACnn |
| MG3 active effectors PAM | 11536 | MG3-95 3' PAM | Nucleotide | artificial sequence | nnnMYAY |
| MG3 active effectors PAM | 11537 | MG3-96 3' PAM | Nucleotide | artificial sequence | nRwYAYn |
| MG3 active effectors PAM | 11538 | MG3-103 3' PAM | Nucleotide | artificial sequence | nnRGCCCn |
| MG15 active effectors PAM | 11539 | MG15-130 3' PAM | Nucleotide | artificial sequence | nnnnCwAC |
| MG15 active effectors PAM | 11540 | MG15-146 3' PAM | Nucleotide | artificial sequence | nnnnGTRY |
| MG15 active effectors PAM | 11541 | MG15-164 3' PAM | Nucleotide | artificial sequence | nnRnRYAW |
| MG15 active effectors PAM | 11542 | MG15-166 3' PAM | Nucleotide | artificial sequence | nnnnGYTA |
| MG15 active effectors PAM | 11543 | MG15-171 3' PAM | Nucleotide | artificial sequence | nnnnCWAW |
| MG15 active effectors PAM | 11544 | MG15-172 3' PAM | Nucleotide | artificial sequence | nnCCRCAT |
| MG15 active effectors PAM | 11545 | MG15-174 3' PAM | Nucleotide | artificial sequence | nnRGAYA |
| MG15 active effectors PAM | 11546 | MG15-184 3' PAM | Nucleotide | artificial sequence | nnRnRYAA |
| MG15 active effectors PAM | 11547 | MG15-187 3' PAM | Nucleotide | artificial sequence | nnnnCAAn |
| MG15 active effectors PAM | 11548 | MG15-191 3' PAM | Nucleotide | artificial sequence | GnnnnCMA |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| MG15 active effectors PAM | 11549 | MG15-193 3' PAM | Nucleotide | artificial sequence | nnRnRYAY |
| MG15 active effectors PAM | 11550 | MG15-195 3' PAM | Nucleotide | artificial sequence | nnnnGAAA |
| MG15 active effectors PAM | 11551 | MG15-217 3' PAM | Nucleotide | artificial sequence | nnRnRTGA |
| MG15 active effectors PAM | 11552 | MG15-218 3' PAM | Nucleotide | artificial sequence | nnnCnAT |
| MG15 active effectors PAM | 11553 | MG15-219 3' PAM | Nucleotide | artificial sequence | nnnRTATW |
| MG15 active effectors PAM | 11554 | MG15-177 3' PAM | Nucleotide | artificial sequence | nnnSRYTA |
| MG71 effectors | 11711 | MG71-2 effector | protein | unknown | MFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKMQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGHIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKCWSLK |
| MG73 effectors | 11712 | MG73-1 effector | protein | unknown | MTKILGLDLGIASVGYAVVNLDEQKFDGGEILTAGVRIFEAAENPKDGASLSAPRREARALRRILRRKTIRLQQIRNLFIKYQILTTEELNHLYASPLPSVWEIRTLSLYEKQPLQHIARALLHIAKRRGFRSMRKSAEEKNYETGQLLQGISLLQNLLKQSGRQTIGEFLYHLPQSEPKRNKAGSYNHSIARSMLEEEVRLILEKQRTYGNTALSSEFEQEFRAIAFDQQPLKPSSPGKCTFLPDEDRAPKQAYTAELFAALSKINHIRIVSQGTSRALSADERQIALDLCLEKENNNFAQLRKLLELQENEFFNISYIIPRAKQNTDYQPEKKTAVYKMTGYHALRKALKDHKPLWTTYMDNPNGGLDQIAVVLATFKSDKEIINALEKLQFPSELIEAVKSLSFSGFMHLSLKAMRNINPFLLEGHTYDKACELAGYNFQAAKRNAGLTKLPPLTEEENFSITSPVVKRSIAQTRKVVNALNRKYGPFDAVHIELAREMGRNWAQRKELTQQQKENQEERDLIKAQGIEGLFPKNSLDIKKIRLWKEQGGYCIYSNQYIKPEQILEEGYCQVDHIIPYSRSFDNTLSNQVLCLTKENQDKRNDIPFDYFQRIQRDWDSFVTLVNASPTMRPNKKQKLLRTELSEEDLAGFKDRNLNDTRFISSFVRKYLLQNLQLTNKYKQGVFCRNGKITADLRNMWGLSKIREQDDKHHALDAIVLACCSNAMMQQISTQYTHNKETAALKIKPLFPWPWKEFRTDVENALLSIFVSRPPRKKITGAFHKETYYSAKHLARGFKTLKTDINTLTAEKLAKQRDLEIKYYGVERNKKLYDAIEQALLARTDAKQPLKVYLGPAQTPVKKIKLIMEG |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| | | | | | NKGVPVLKGTAVAENGAMPRVDVFYKNGTYFLVPVYTIDFTKEKLPLI SIPDNQPMDVRDFRFSLYKDDYVQIKNKTGETFEGYFKQYNAQTGQIY LETHDRSDSYTVSGKPASEKKFSKSTFVDFTKYQIDILGNQHRVEKEKY TGITRKNKGFGG |
| MG89 effectors | 11713 | MG89-2 effectors | protein | unknown | MSYVLGLDLGIASVGWSIVEPGNRIIDLGVRVFKKAETDKEGDPLNLIR RESRLSRRRLYRRAHRLSRLLNFLISSGLIHSKDEVLKNVYNENPWALR TLGLNSVLTNNQLARVIYHICKHRGFYWASSADDGQADNGKIKKSLSS NQLVMKEKGYKTVGQMIFTEYPNCQRNKSGEYSKSLPRTDLDKELRA IFKAQQSFSNPIVTKDFINAIVGCGDRKTGFLWEQRPALQGEDLLKMV GHCRFEKDELRAPAANFYSEQLVWLTKINNLRVYDEDSQERPLTREER DLILNMPLEMKSDIKYSSLTSAFEKANLWKSGQFKYKSVDYEQKTQKK KNTAKSVDITKSSKKNPEDKVFYKSSHLHEIRKALGSSLSEEWEKIRTE VLSGKYDRYNRIAYVLTVYKEDSDVIEQLSPYESRTLIEALLPVRFSGFV ALSEKSLKKIIPHMVLGKRYDEACSEANYKHYKQNQAEFKKLKYLPPL FSGREPNGTLIFNEEIGDIPRNPVVLRVINQTRKVVNAIVKKYGSPKSVH IELARDLAKSRAERNEIEKRNEEAASRHIKERDEFEKLFGSKCLNGTNL LKYRLYKEQDCKSMYSSKEIDHKRLFEKGYVQIDHILPYSRSYDDSQSN KVLVLTNENQDKGNRIPFEYFEAKQHGFSWYEFEQWVKSCKNLNQKK KRNLLRCSLSKDAKKDFLERNLNDTRYACRFVKNYIDSFLCLSENSDNS GCVVVAGQLTAYLRNCWGLNKVREENDRHHALDATVIACCTRKIVQ KVGAWSKSREMNSYNSSYVDPDSPVDEDEKLLQKLYVNTRKPDFPKP WECFRSEVESRVFESALEKLKEKLKLQCSYTESELKNVRTLFVSRACE KIGKGALHGDTVYRQTSEMRKENVAVKKVSLKKLKYARIEAIVDADT RNKNLCDALKKRYEEYARKIGKKIEDFVDKDIAKIFADDNPLHMPNSD GQEDPCNPIVKSVRVKEAFSGVPIRNGVAGNSTIIRVDLFKKDGKYYCI PVYAWNKTLPNRAYVSGKKETDWALVDDSFEWCFSIRQNELLKIKLK GETIFGYYNGFDRDRGSFNILLHDRQDGKDHKQGLIRKGIKTAISITKY DVDVLGNYYLSKPEKRLELA |
| MG73-1 sgRNA | 11714 | MG73-1 sgRNA | Nucleotide (RNA) | unknown | (N24)GUUAUAGUGGGAAAUCACUAUAAUAAGUGAAAUCGCAAGGCU CUGUUCUUGAACAUCCUUUAUUAUAAAACUCCUGCCAAUCGGUUG GGAGUUUU |
| MG89-2 sgRNA | 11715 | MG89-2 sgRNA | Nucleotide (RNA) | unknown | (N24)GUUGUAGCUUCCUUGAAGAAAUUCAACGUUGUUACAAUAAGG UUUUCGAAAGAUUACCGAACCCGCCCUCACUUAGGUGAGGGCUUU U |
| MG99 effectors | 11716 | MG99-1 effector | protein | unknown | MRDLSYRIGLDIGIGSIGWAVVSSETEDHPARIENFGTRIFDSGEDPKTR ESLCQARRADRGVRRLERRRAFRKEMLKNHFQNIGLLNNTENDDYES CRDDDVYLLKVKGLDGKLEAAELFKCLAHTCNHRGYKDFYEPEDDDE NEESGVNEKAANLFEKEFAASGKRTVSEYLVEKYFNNGFVKFRNRSGS DAPYMLIRRSLLKDEAEKIIKKQSEYYPCLGGINAERTVSIIFSQRDFED GPGDPNDPHRRYHGFLETLGRCPYYKDEKRGFRGTVISDVFAVTNTLS QYVFFEKETGECRLDPKIANELVSYLLTNAGLTMTEVKKILKSHGYEL KKSEKSDDKAISKAVKFLSIAKKCVEEAGKSWEALISEDQFDAANLSTL HRIGELISKFQTPSRRVQEMKKAGIDGDLIKAFSGKKISGTSSVSYKYM TDSINAFLSGDIYGNFQANFIKENAAVKEEERSYKLEPRHIDDPEVRDN |

TABLE 24-continued

| Category | SEQ ID: | Description | Type | Organism | Sequence |
|---|---|---|---|---|---|
| | | | | | RVVFKAINETRKVVNAIIDIYGSPEDIVIEVASELGKSVEARIEETKRQR ANEKENDRIKSEIAKLLSIDVQSVKTTMIERYKLYNIQEGKCAYSLEPL GDLKDVVENVNKVYEIDHIVPFSLILDNTLNNKALVFTRENQTKGQRT PLMYLSEEKAKEFLAFSNHLFSKKTGGISKTKLEYLKLETIYGEAAAEK LNAWKSRNINDTRYITKYIAGLFDKQLIFAGDKKQHVFTVKGSVTQKF RREWFRGTEWGKDEKDRTTYLNHALDALVAANLTKAYIEIGSDAIKLS QIYRAHRYQITEEYESYLDKCVKKMSKYYGFSEGYTKKLLSKPERIPSF VPRLKEEVAVRENDSDSEAFDKGVSKLYSAEAPFIDPPHIPITSHKQNKK FKGCIADSNPIRVEEIDGEAHKIRRIDIKTLSAKKLKDLYTGDVSLREEL AAMLDGKPESYTVGDSLKESGKEFFLSKSGAVIRKVSVDDGIVSNYYR KEIKDGQYSTLGMLKYYCIEVYKDAKGKTRIYGIRFVDVVKKNKKLY QKAESYPEDYASHVMYLFTGDFVRITDKKGKLKFEGFYQAVKNINSSI LYFSPVNLANTVIKGISLTDNIEKYYVDILGRIGGKIRCSEPLQSTAEKK SL |
| MG14 sgRNA | 11717 | MG14-241 sgRNA | Nucleotide (RNA) | unknown | N(20)GUCUUGCCGGAAACGGCUAGACAAGGGAAUCGCUUUUACGCG AUUACCCGCAAGGUAAGCCCGUCAGCACCCUUGGUGUCGGCGGGC GAUCCUUUU |
| MG16 effectors | 11718 | MG16-1 effector | protein | unknown | MIKNILGLDLGVGSIGWALIQTEDDQPKQIIGMGSRIVPLTKDDSDQFT KGQAISKNAERTARRTTRKGYDRYQLRRALLTQVLRQNGMLPECMD ENMIDLWKLRSDAATEGKQLTLQQIGRVLYHINQKRGYKHAKSDDNG DSKQTKYVEAVNLRYKEIQEKNVTVGQHFYAELLNSKVESGNGPYYTF RIKDKVFPRAAYIAEFDQIMGVQKEYYPNVLTDELIETLRNRIIFYQRPL KSCKHLVGLCEFEMRPYKKDGKIVYGGPKCAPRTSPLAQLCAMWET VNNITLTNRNNERLEISNEQRRQLVQFLCTHETLKLTDLYKILGITKKD GWYGGKAIGKGIKGNVTLNQLRKALDGKYSQWLEMPIERIDVVDRNT AEAFWAVSPKVEETPLFQLWHAVYSLQNVEELTKTLQNRFSITDPQVI DALCKIDFVKPGYANKSHKFIRRLLPYLMEGMMYSEACACIQINHSNS MTKAEREARPLAERIELLQKNALRQPVIEKILNQMINLVNRLQQEYGPI DEARVELARELKQSREERKDAFDRNNKNEKRNKEISALISEQGIRPSRS RIQKYKMWEESEHRCMYCGKVVNLSEFLNGADVEIEHIIPRSILFDDSF SNKVCACRDCNREKDNMTAMDYMASKPEGEFEAYKQRVDEAFNAHR ISKTKRDHLLWRRADIPQDFIDRQLRLSQYIATKAVEILQQGIRQVWTS GGGVTDFLRHQWGYDEILHTLNLPRYRQVEDLTEMVHYEHAGQEHD EERIKNWSKRIDHRHHAIDALTVALTRQSYIQRLNTLEASHEHMEKLV KEANTPYKEKKSLLEKWVALQPHFSVEEVTTQVDGILVSFRAGKRVTT PARRAVYHGGKRTIVQRGIQVPRGALTEDTIYGKLGDKFVVKYALDH PSMKPENIVDPTIRLLVENRITALGKKDAFKTPLYSAEGMEIKSVRCYT SLSEKGVVPIKYNEKGNAIGFAKKGNNHHVAIYKDQSGQYQEMVVSF WDAVERKLYGVPTVITNPKTVWDELLEKELPQDFLEKLPKDNWQYVL SMQENEMFVLGMEEDEFNDAIDTQDYNTLNKHLYRVQKLSHADYTFR FHTETKVDDKYDGVENGRNTSMSLKALVRIRSFNGLFTQFPHKVKIDI MGRITKA |
| MG16-1 sgRNA | 11719 | MG16-1 sgRNA | Nucleotide (RNA) | unknown | N(22)GUUGUGUAUGGAAACAUACACAAUAAGGAUUAUUCCGUUGUG AAAACAUUCAGGGUGGGACGCAAGUCUCGCCCUUUU |

TABLE 24-continued

Listing of additional protein and nucleic acid sequences referred to herein not included in the sequence listing

| Category | SEQ ID: | Description | Type | Organism | Sequence |
|---|---|---|---|---|---|
| MG73 effectors | 11720 | MG73-1 effector | protein | unknown | MTKILGLDLGIASVGYAVVNLDEQKFDGGEILTAGVRIFEAAENPKDGASLSAPRREARALRRILRRKTIRLQQIRNLFIKYQILTTEELNHLYASPLPSVWEIRTLSLYEKQPLQHIARALLHIAKRRGFRSMRKSAEEKNYETGQLLQGISLLQNLLKQSGRQTIGEFLYHLPQSEPKRNKAGSYNHSIARSMLEEEVRLILEKQRTYGNTALSSEFEQEFRAIAFDQQPLKPSSPGKCTFLPDEDRAPKQAYTAELFAALSKINHIRIVSQGTSRALSADERQIALDLCLEKENNNFAQLRKLLELQENEFFNISYIIPRAKQNTDYQPEKKTAVYKMTGYHALRKALKDHKPLWTTYMDNPNGGLDQIAVVLATFKSDKEIINALEKLQFPSELIEAVKSLSFSGFMHLSLKAMRNINPFLLEGHTYDKACELAGYNFQAAKRNAGLTKLPPLTEEENFSITSPVVKRSIAQTRKVVNALNRKYGPFDAVHIELAREMGRNWAQRKELTQQQKENQEERDLIKAQGIEGLFPKNSLDIKKIRLWKEQGGYCIYSNQYIKPEQILEEGYCQVDHIIPYSRSFDNTLSNQVLCLTKENQDKRNDIPFDYFQRIQRDWDSFVTLVNASPTMRPNKKQKLLRTELSEEDLAGFKDRNLNDTRFISSFVRKYLLQNLQLTNKYKQGVFCRNGKITADLRNMWGLSKIREQDDKHHALDAIVLACCSNAMMQQISTQYTHNKETAALKIKPLFPWPWKEFRTDVENALLSIFVSRPPRKKITGAFHKETYYSAKHLARGFKTLKTDINTLTAEKLAKQRDLEIKYYGVERNKKLYDAIEQALLARTDAKQPLKVYLGPAQTPVKKIKLIMEGNKGVPVLKGTAVAENGAMPRVDVFYKNGTYFLVPVYTIDFTKEKLPLISIPDNQPMDVRDFRFSLYKDDYVQIKNKTGETFEGYFKQYNAQTGQIYLETHDRSDSYTVSGKPASEKKFSKSTFVDFTKYQIDILGNQHRVEKEKYTGITRKNKGFGG |
| MG73 effectors | 11721 | MG73-2 effector | protein | unknown | MNKILGIDMGIASLGYAVVNIDDENFVNGDILASGVRIFDVAESPDGSSLAAPRRAARSVRRILRRKVMRIKAIKQLFLDENLLSPQELDLLSKQDFKTLYQATPEGQPIPSVWEIRARALDNPCSLVDICRALLHIAKRRGFRSMRKSEKLTGEAGKLLKGVEEMQKKLQESNFRTIGELLFHLPATEPKRNKDGSYSHSVARSLLEEEVHLILQVQRAKGANALSQEFETQFCKIAFLQNPLQPSDPGFCTLEPTEPRAPKNAYTAELFAALCKINHIYLEEDGQSHALSAAQRALALEKCFSTQKTNYKQLRELFNLPNDIKFNISYTAPAKKKSKKKEEAQSPEQAVQAPQEYDAEKNTTLYNMAGFHALKKALKSSPLWAEYQTNPNGILDKIAEVLSRYKSDGEIRQHLTALGLPAEAVEKLQNVNFSGFMNLSLVAMNKIIPFLKEGFRYDVACKKAGYNFQAPQQNKGLSKLPPLTEEDNHTITSPVAKRSLAQARKVINALNKKYGPFDAVHIEVAREIGKSFEKRKEIEAEQKAHAEERARLKEVGIDGIIPQTETDLKKLRLWKEQDGRCMYSLQYIEPRKILEEGYCQVDHIIPYSLSFDNSLNNQVLCLTSENQHKKNQIPYEYFHSGKAQITWEDFEGYVNSLQNIRMAKKHRLLKQELTEDDLQGFKERNLSDTKLISRFMKNYLLANLRLTGKYKQGVFCVNGKHTSTLRGFWRLQKIREDGDKHHALDAIVIACCTNRLMQYISTKYRQNRELELQRKEVAVPWPFPHFKHAVENSLLSIFVSRPPRKKVTGALHKNTFFSAKHIKKGIKTLRTDIQKLTLDSLKKQRELEVKYFGVERNKPLYDLIETALNNRPNDKTPIQVQMPTKNGGFVPVRHIKLISESTSGIPVLGGTALAENDSMPRVDVFLEDGQYYVVPVYTMDFAKGVLPLVAQPSGRLMKKENFVFSLYKDDYVNLVNKQGETWEGYFKQLNAQTGQIYLESHDRSAQYTVSGKPSNQKKIASSTLKLIEKYQIDIFGGKHLVKKEKYIGIIRKNKGFGG |
| MG74 effectors | 11722 | MG74-1 effector | protein | unknown | MQVHDDVILGLDIGVGSLGWALLEEDLQTGEQRLLQRQTPQGETTYALGVRLFHVPENAKTKELLNVKRRTARMQRRTTARRAQRMRRVRALL |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| | | | | | DSLGVPGVRDADAFHLGKGRGAQCDPWQLRREGLERRLEAREWAVV<br>LLHIAKHRGFRSNSKTDRSGSDKEMGQVLQAVSNLQQEVEASGLTVG<br>ALLASRERRRNRADHTGAPRYDLCMLRSLQENEVDILFTRQRELGNPL<br>AGEEVRCRYAELAFAQRPLAPVSHMVGPCAFLEGERRAPRFAPTAELF<br>RYVQALCNMRLRQETGEETPLSEEQRQAACAVFGSVQSVTYKKLRQV<br>LRLPAGCRFAGLSYGVTEKGNVQDPEKADVVMRTGKCCQGTACLRGI<br>LGDAYEALHEQRLDEADAARLAATGALSAPAAALLARGMAGLRLTDA<br>VARIVSELNDLDQIRAVLALLPLAAPRIAALSQAAGEGKLGIFQGTARL<br>SLRAMEAILPHMLACGEYAAACELAGFDPRAAQKTDVTDIRNPVVLRV<br>FREVRRQFSAICREFGFLPGRVHVELLREVGKSGEERNRISRGLERRTK<br>EKEAARKAVAQLLGKSPETVSAGEVQRYELWRQQDGKCAYYMLWR<br>HAGGERAYGDAMPQGSIPPDWLADGVNAVQVDHILPRSRTFDNSFHN<br>LCLCCHAANQAKGGRTPWEWLGAAQPQAWHDFEQWVQSLPLKGLK<br>KRNYLLRDLNAEVQGRFHARNLTDSGYVARLTLRWLEEEYARHDVP<br>MQDADGRTRRRFFARPGQVTDFLRRHWGVQALKKIDGQRSGDRHHA<br>LDALLVAACSEGMLQRMVRAFQREENGPERLHIPCPWQDFSATVGRA<br>LGSVFVSRVERGRTKGPLHEETLRAIREERQPDGETRRVLYERKAVAR<br>LTAADLDKIKDAARCPDVVAALRRWLDAGKPGDALPRSAHGDIIRHVR<br>VCAGEFSSGVVLQRGSGQAQASNGGMVRTDIYSRDGKFYMVPVYAKD<br>VADKRLPLRACVAAKAEKDWREMTADYRFLFSLTPDCYVLTENRKGE<br>VKEGYFAGANRNTSAISLSLAHDKQNVIQGIGITTLKRFEKYRVDRFGR<br>LSLVRREADPRGRS |
| MG86 effectors | 11723 | MG86-1 effector | protein | unknown | MKKILSFDLGITSIGYSVLTEDEAQKYSLLDYGVSMFDKPTDKDGNSK<br>KLLHAQALSTKKLYKLRKERKKNLALLFEKYALAKASKLLEQEKKNL<br>YMYKWQLRAKKVFEERLSIGEIFTILYHIAKHRGYKSLDSGDLLEELC<br>VELGIKIDVKKEKKDDEKGKIKQALSTIESLRKEYPKKTVAQIIYEVEL<br>QKERPVFRNHDNYNYMIRREHINDEIATIIRKQKEFGNFENIDSEVFIVD<br>IIAAIDDQKESTNDMSLFGKCEYYPKEHVAHQYSLLSDIFKMYQAVANI<br>TFNKEKIKITKEQIRLLTEDFLNKIKKGKSVKELKYKDVRKILKLDESV<br>KIFNKEDSYQRAGKKVEHTITKFHFVDNLSKIDKSFIEDIFNADESYVL<br>MREIFDVIHKEKSPKRIYEQLKSKVSSEAVIIDLIRYKKGSSLNISSYAMA<br>KFLPYFEEGMTLDAIKEKLDLGRKEDYSVYKKGIKYLHISTYEKDDDL<br>EINNHPVKYVVSAVLRVVKHLHAKHGTFDEIKVESTRELSLNDKVKKE<br>IDKANKAREKEIEKIISNDEYQKIAKEYGKNIHKYARKILMWEAQERFD<br>VYSGKSIGIDDIFSNRVDVDHIVPQSLGGLYVQHNLVLVHRDENLQKSN<br>QLPMNYITDKEAYINRVEHLFSEHKINWKKRKNLLASNLDEIYKDTFES<br>KDLRATSYIEALTANILKRYYPFIDEKKSVDGSAVRHIQGRATANIRKV<br>LGVKTKSRESNIHHGVDALLIGVTNPSWLQKLSNIFRENFGKIDDEARK<br>NIKKALPYIDGVEVKDIVKEIEQKYNSYGEDSIFYKDIWGKAKTVNFW<br>VSKKPMISKVHKDTIYADKGNGIFTVRESIIAKFINLKITPTTFPEDFMK<br>KFHKEILEKMYLYKTNSNDVICKIVQQRAEEIKELLWSFEFLDVKNKE<br>EMQEAKANLESLVHRELFDNNGNVVRKVKFYQTNLTGFKVRGGLAT<br>KEKTFIGFRAFKKDKKLEYKRIDVSNFEKIKKSNDGSFKVYKNDIVFFV<br>FDEEKYKGGKIVSFLEDKKMAAFSNPKYPANIQAQPESFLTIFKGKANS<br>HKQVSVGKAKGIIKLKVDILGNIESYQVLGNAKSKLLDEIKSIVSH |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| MG86 effectors | 11724 | MG86-2 effector | protein | unknown | MKKILSLDLGITSIGYSVIEEFGNDRYSLIDYGVSMFDKATDKDGNSKKLLHSASTSTSKLYDLRKKRKKDLAQLFHNFGLGDKNSLLSQEKQNIYKNKWYLRCHKAFKEKLNINELFTIFYTLAKHRGYKSLDSSDLLEELCEKLNIPLETKTKKDDERGKIKKALKTIEELKQNSTKTVAQIIYEIELKKENPTFRNHDNYNYMIRREYIDQEIEKIIKTQKDFGLFDDKFDIDNFIEKLKDIITYQNPSTNDMRLFGNCEYYEDEKAAHQYSVISDIFKMYESVSNITFNTKPSIKITKEQINKIADDFFTKIKKGKNIADIKYKDIRKILALSDDTKIFNKDDSYISKGKKVEHTIIKFHFVNNLSKFDNSFIVENLNSLENLKEIFEVLQFEKDPTAIYEKLKDKIEDKQTIINLIKHKSGNSLNISAKAMVEFIPYFKDGLTTDKIKEKLELNRCEDYSKFYKGIKYLNIRQFEQDDNLDINNHPVKYVVSATLRVIKYLHIVCGTFDEIRVESTRELSQNEETKKAIEKANKELEKQINDIVQNKEYQNIAQHYGKNLQKYARKILLYEAQNRRDIYTGEGIEFEDIFTKKVDIDHIVPQSVGGLSVKHNLVLVFRDTNIQKSNQLPMNFVKDKQDFINRVEHLFSEHKINWKKRKNLLATNLDEIYKDTFESKSLRATSYIEALTAQILKRYYPFKDKEKQENGKAVSYIQGRATSNIRKILKVKTKTRDTNIHHAIDAILIGLTNQSWLQKLSNTFRENFGKIDEEARANIKKDMPIFEIIIDDEVKYLEPKELVELIEKNYNYDGENSIFYKDIWGKIKSVNFWVSKKPMVSKIHKDTIYSKKDDGIYTVRENIINHFINLKITPKTSSKKFEEEFNKKILNKMYLFKTNPKDAVCKAIIKRANDIKTLLDSFIDIDTKDKEAMNNAKTKLDELIHKDIPDNNGKPIRKIKFYQTNLTGFDVRGGLATKEKTFIGFKAQIINGKLNYTRIDVANIDKIKKENDNSFKVYKNDLVFFIYTDGTNKGGKIVSFLEDKRIAAFSNPRFPSSIGFQPHFFVTIFNGKANSHKQHSLNKAIGIIKLNLDILGNIKSYQKIGSCESELLEFIKKVIKD |
| MG87 effectors | 11725 | MG87-1 effector | protein | unknown | MEKYIIGLDLGINNVGWSVVDAQTNKIKYLGVKQFEASDSAKDRRTQRNTRRRLKRRETRKTDILKILSNINFPNNLTIDTMLIETRCKGINEQISKQDITNILCYMATHRGYIPFGDEEVSFVDLDGKYPCEYYYEMFKSSTNNKYRALRNTVKNEENINEVKKMLETQRKYYPEITNETIENIVTTLQRKRKFWEGPGSINALTDYGRFKTPEDVVEYLDKKKENPEYEKYIFEDLIGKCSVIPNEKCVSQINFYAEKFNLLNDFINISFKSIEELNNKDDFYETQVKTYKLRESGLNKVFDYCMSKDTLTIKGLFKDLFATTIDNISGYRQDGHDPNKPEMSTMNTFRSIRKTFKECNANMDIFKPENTDLYNEIINYMMLVPGQVELINMLSTIMPLSENDKEALKKVFKSKKTNLKYHSLCEKILIRACNDMLSLQKNYMQVYKLKDYGKESRKEFVKRYEESNKGEKLMNPTFIDDIISSPQVKKTLRQSVKVINEIIKNEKSLPDVIVVESTKDTLNSEKMRKVYIDINKKQKALHDKAIKTLSSIGYSEKDISKKKIEKLMLYEEFDGLCPYCNNQITLKYLINGSDEIEHILPRSNSFDDSFDNRTVSCANCNKNKNNQTPLEFLKGNEKESFIERIKSNKNISEFKKENFLFAGDISKYRTRFFNRNLRDTAYATKEMINQINIFNLYLESKNKDERIKTLSTPGQITHSIRKRYDLEKDRDTDIPYHHAIDASILALLPTTKIGSKVVMFQNDNKFFLNENNKDKMTEIGLELKYYDTSEGKIEYDDYIADFKNINDTSNIFMYSPEVKKEPNKGLFNANMYKVIKIDDKYYKIDQINDIYNLSDSDKKLLPKLFDDAKNETLLCKLQHKEFYEKLKNIYIKYSDSKNSPFEDYQREINNLSKEDKFDYLKHGLKMSENAPSVKRLRYYTPISEPYLIDKKSINKKDGTYLAFDSLAQAGIEVYYNETKNCFAFVPIPSVCYNLKTRKVNRKHKLYKRYKELNLKDYKVKYIVTLYNGNTIEVLKKDNTIIKGVVSSYHKTNDKIVLKNGSYFTKSDLEFSIIDYNPIGKSQKRLTKRIK |

TABLE 24-continued

Listing of additional protein and nucleic acid sequences referred to herein not included in the sequence listing

| Category | SEQ ID: | Description | Type | Organism | Sequence |
|---|---|---|---|---|---|
| MG87 effectors | 11726 | MG87-2 effector | protein | unknown | MKKYTIGLDLGINNVGWAKYDLETKKVIDKGVVRFKESSTAQDRRIIR<br>GSRRLRKRKQHRVERLAIQLSNINFCTSRSYEPELLNKRIKGLNESLSE<br>QEITNIIYWFAIHRGYIPFDEEKPEREVHKFAEDEYPCQYIFDYYKEYG<br>VYRGQCDLISLKDNLKELKQILLTQQKYHSKLTDEVIDNILYIIQSKREF<br>WEGPGASKENQLSPYGRYRTLEDLEKYKADPTYHQYLYEMLIGKCEL<br>SIDKDGFMDQVAPKCNFYAEEFNFYNDFINMSVKEPSQIDEEYRNKITL<br>KGKFTEDTIEEIKKEIISTKKVSLDKLVKKILGLELKDIQGYRIDKKYKP<br>EISQFEFYKYLLKSFKDEKLNPSWLENDDKTIYNQIVYILTVAPSTYAIE<br>DMLKDRVKEVEFKKEEIDVLIDIKKKKNPDLKYHSLSERILKKALDDIK<br>RHNCEYNFMQIMKRLEYEKEMKEYFQNNYSTKTQSPYTIEDQYIDHLI<br>ANPQVKKTLRKAIKIINAIIKEEKNYPETIVIESATSLNSKERKKQIEEEQ<br>KTFNQLNKEVKKELEDNGYEATDKNMQLLINWKETNESCIYCGESISL<br>KEVLITEIEHILPKSKSMDNSHNNTTCSCLKCNKEKNNRTPYQYLTSKN<br>MYEGFKNRVMNQYDKMSQDKKSNLLFEGDIDKYSIKFINRNLRDTSYA<br>SVALVQELKKYNEYLGAKEGYKINIITSPGQLTSKIRQYLKIKDKDRTY<br>LYHHVVDAMILASIPDTEIGKVLIEAQNDSQYWFKDKNKENKYKEEVY<br>NMLNNVWLSNRDQIQKFNQDCDNMPDNNKEGLIKRSYEVLKNPVRQF<br>SQYTEYAKYIKQNDVYYKISQIDNIYNLLIRKKDGSADKDKKLLDELFD<br>LSNKKNKTLLCEKKDPKLYQKLKNIYEKNSFSINPFVDESKYMYGLED<br>GDKFDCLKQGIRKTDNSNSPLVIKLRYLEKVTNPYIKNNITTRRKNLYN<br>EFTINKPKKDTLIGLDGLKQVSTRIFYSYEDKKFIFLPICAISFVNGKLN<br>KKEKNYQTTYNRLIGNKNVKEMGNIYVGEWVGVYKKNGEYFEGRYK<br>GYHKTSNVLEYYINGLDTLSCATIGSSDLRIIIYTTDILGNRHIRLDTQKE<br>I |
| MG87 effectors | 11727 | MG87-3 effector | protein | unknown | MTKNYSIGIDMGVNNIGWSILNNDTKKLENYGVRLFPTSNDAKERREV<br>RNTRRRLKRKETRLDDTLYLLKKYGFNEDNTIEENLIEKRVKGLNEKL<br>EKQDIVNILCYMIKHRGYIPFGDEEVTLVDLNGKYPCEFYYEMYKNGG<br>KYRNRKMTVRITDNEKEIKKILETQSKYYKNINQDFINKYLNILTRKRK<br>YWEGPGSINDLTPFGRFKTQEDVENYLEEKRKNPSYEKYIYEDLIKKC<br>DYELEERCCCKLNIYYELFNMYQDFINVSFKNIEELENKDCFYETKNGL<br>YKLNKKGLLMVKDYCMNNFKLKYTDILKKLFNTDKDNISGYRIDKDH<br>KPEFSTLNSYRKIMLEFTEKGFDTTWVSDYNCYNEIMEKMTLTPGGVE<br>FIKEIENNKLVPYKFNEEEKSLFKELKEYFNKKTLLSYGSLSQKILQKAI<br>NDMLDLEKNFMQVSRIKDYGKEARENFIKQYKKTSNKLEINASFVDDII<br>ASPQVKKSLRQAIKIINAIIEKEGCLPVSIAIESTKELNSDKKKKEIEKEQ<br>KIQENLRKQASNYLSTVFGDSSVTETNILKVMLYNETNGHCAYCNKPL<br>SINDIFADNIQVDHILPISKSENDSENNKIISCKKCNDDKKNNTPYQFLKN<br>KNYFEEFEKRVLENKNISDYKKDNLLYKDDLDKYKTRFFNRNLRDTAY<br>ATTELINQIEIFNNYLEILDKKRINTLSVPGQITSSIRNRYVKNEDKTSLE<br>KNRDAGVFHHAVDASIVVSVSDTHIGQIMLKAQNDKEYWIKNKSNYDD<br>IYKYLINLRIDDTINQIEKINNENIKVSKQVSKNPQGKLANSNIYKMIKK<br>DNEQYIINQIDNIYTFDFKKDENKKLFEKLLNEENNEFTLLCYDNDKNT<br>FNYIKKIYNEYKNEKGNPFVNYLIDKGEIPDGNSFDYDITGIRMVTKKG<br>NGPIIKRLRYYSKKNDLYILNKKNINKKDSNYLALDSLKQFCVKVYVD<br>NDNKKFVFLPIYTISLDPKTKKVNENDEFYKLFYNKYIGNKNVTFFADI<br>YNGNKLEITKKDGTIVSGYYSTFNKANNKLILNNGDTFTLSDKKISIIHT<br>DILGNEKKG |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| MG88 effectors | 11728 | MG88-1 effector | protein | unknown | MKYKIGLDLGSTSLGWAVVELNEADQITSLVDMGVRIFPDGRDAKSH KPINVIRREHRQMRRRGDRVLLRKKRVLQLIHKYGLDFDISADIKLED PYVLRARAVSDKLSSAELGRVLFHLALRRGFKSNRKETRGDSGGKLK KATLALHDAIGDKTLGEFQVDSKRYRFADQFDGNKIKDGALYPTRDM YLDEFNRICSVQNMSDDMRQQFEYAIFHQRPLVPPEIGTCMFELDQPR AYKFEPVFQRFRVLQQINQLRIINNGEIKELTAEQREKLQDALLATFCG VKRDKSGRPKITFAEVKKLLGLSRNTKFNLESEKRKDMDVDATAFAFA ECELADFWRACTDNVKSQVLAHLNDDELSDSDLVDYLAHEYGISQDK AEKLIQQPFEDGVANLSVCAMQKMLPFLEQGHLYHIAAKEAGYDHAD RGIVHLDTLPYYGDVMALRPSLVQDKMGRYRTMNATVHIALNQLRAV VNDLIARFDGEPYAINIEMGRDVSAGADERAEIEKQQAANKRENDRIAT ELVAMGVRVCRENIQKYKLWENLGKSPLDRRCVYTGEIISKEKLFSPE FEIEHILPFSRTLDDSMANKTISAAVANRFKGNRSPDEAFSDPKSPWKY EDVVARAQNLPDATKWRFNRGAMDVFLQGKECIARAMNDTRFMTRM AVTYLQHVCADKNRVNGMPGRLTASLRDEWHLNWWKNKAEESKYR GNHIHHAIDAFVIACTDENILRKLADAKSDMHTPFPGFDYFDFKMRCE NTIISYRQSQKNPKDAHSTVGCLHEDTAYNLECFEDGGCGVNAVMSHR EELPTTDKDKKAFAKDFKNVNPKTLQMFLNDAGVANEEPDIAIKFLD WCAMRNIRKVRMYKTGVDVTTYVPVFRTKKQRDVYRAAYLNWYVN TGVASGIVDKKLRAVQQEKEKHLLQEFQDAAKQAYKWYVGGNNFCA EIFEIRDDDTRYPKLRGRWQVEILSNYNAQLNAGAPLWRHKYATAKRI MSLRINDMVMAEFSKDDPKLPKGLVETVAHQCAIEKTDKVNVVFRVK KLNSSGTVYLRPHFIAKEDADTKSWIASATSLQEHKARKVCVSPSGKIL GLK |
| MG88 effectors | 11729 | MG88-2 effector | protein | unknown | MNYRLGLDMGATSIGWSIYDVETEKLLDTGVRIFDDGREDKSKASLCV KRRNARGARKLNNRRHIKTQELLKILTTLGLFPQEQNKREDLKNDNP YKLRKEALDRQLSTYELGRTLMQLAKRKGFKSNRKDNREEGGKLKK GFAELKDIMQKENARTYGEFLYNCMQRNPDKPIRLKNTFDESGKYKG GLFPFREIYVNEFEQIWHKQKEYYPQILTDENKEKLKNIIFFQRPLKEA EEGECQFEKGEKRIPRAHPLFQEFRIWQNVLNLTFSAENEPDYKPLEK VQELIKLLMNPQEVKPNKQGIIIYANLKKALGLDKNGVFNFERQNNRD TDLEKGLLVNTTQNAINESEFLAPYWNNFSDAQKGELINVIMRPHNYIP FPKTRISIEEEDDLIINYVRKRFNLPQEAAEELLFDIDLEDDFGSLSEKAI SKILPFMKQGTPYHDACQSAGYHHSYKEYEHIDKLPYYGEILGQSCLG KKNNPKCVEEEFGKINNATVHVALNQIRHLINEHIMRYGKPYDIAVEYA RDLNASTQERLAMTDTRDKNELENQRIIKELQSKLGNHPYSKNDIQKY KIWKKLPFYDKNPLIRECPFSGEQIPLSELLNGQKFQIEHLIPFSRSLDD SLNNKVIATVEANRYKGNRTPFEAFGQSKDGYNWKDIQHRAKKLSVE QQWRFAPDAMQRFEKQEGPIVRSLIDTRYMTRLLQDYLQPIVKEDGK QRVQAVVGQLTSLVRKAWGLNVYKEKADKDKYREFHNHHAIDAIVIS AINRAQIKDVVGILAHVRDDIREEYKDELFQLSDNNVPEDKKREIKKEI RDVTAKREIAIAKKYFPLPKSFNIPDILQQVAAINISHKPNLKNIKQKDS TIGQLHQDTAYGLQKFVDDKSLKAIFKTKKAGDEASDDKTTPKDITQY IPMFRNKEDKKAYYDAFREWFKFNGKAASMDAKTKEDKKLKAEIAQ KEQAAIQTLRQTALKAFKWFVGGNNFCAEIYEINPNNKIEGVASKDRG EWKTEIVSNYNATVRNSRGEDIAYWRYKYPNAKRIMSLRGNDMVMAT |

TABLE 24-continued

| Category | SEQ ID: | Description | Type | Organism | Sequence |
|---|---|---|---|---|---|
| | | | | | FSREQAFDEKFPKGIQEYVREKFQQKSDCQELDILFRVKKMGSNGICF TPHNIAKENADTKSWIASAGAMQKYRVRKIHISYMGRIQNA |
| MG88 effectors | 11730 | MG88-3 effector | protein | unknown | MKYKFAFDLGSTSCGWAVVNTDEDGNVVGLADMGVRIFPDGRNAKT KEPLQVARRNARGARVRNDRILQRRHKIIDLLKENGMIYDCSDERENP YKLRSDAVDKEITLKQLGRIMYNLSLRRGFKSNRKPTQKENDSDLKKA TEKLKQELKGQTLGQYLWGKMKKNLDKEKENKGKDVKNKIGKVRF SNLFDGNKIKDGSVYPSREMYEDEFNRIWSKQAEFHDILTDELKGKFY NAIFFQRPLKPQQRGFCMFEDGELRIYKAHPLFQRFRALQTINQMEID DKPLTEEQREALKKELFEEFKTKNTKAGTVSFSDIRTILGLKKGVKINL EKNDDDENDGDNTRADKTPEDKDNKKDDDKEYDNIYADKTAYLLSRP ECFGEKWFEIPFDEQCSIVDILTDCVYNNIEEKKKYDEQQEQNGKHILE DDEIKQFLQEHYNLDDEQCNAIMNAPLEEGTGSLSQKAIEKILPYLEEG QLYNDACKSAGYHHSLFDGDVEMLGELPYYGDVLKKSCVQDKDGNY RITNISVHVALNQLRLVVNELIKKYGNPDFVAVEIARDLKMGTEELKN LNNKQNSNKKENDKITKAIKEANGNPNNAKDREKFKLWELCQKRCVY TGKQISATELFSDRVHVDHILPFSRTFNNGFFNKVVCFGDANEDKGNST PYEAFKNGYQGQSYEEILDRVKKIVEAMKEKKMFKKKTVKDKDGKK KKVDIDEFSWRFKEDAMEKFKEQEGLIARQLNDTKYMSRLAVQYLKH ICKVEYYTDEEGKEHRKNNCYGLPGTMTDFCRKGWGVNWLKDKSNK EGYRSSHAHHAVDAFVVACMTRGQLQKIASMANWIEEHGGQCQDDK LYLSILFKKCKKPFDTFDRERIYELCDKMPISFKPKLKDPKQENSTVGA LCEDTAYSLLEFDKGLNGVFVKREDVGSLVLKDLPNIIDTQADKLIKEY VETEEAFNKFKEYCEKNGIKKIRCKSFADVSTYIPIFKTKEERDEYHKA YEDWFIFEGRSPANETEEQKQERKEKEQELLKIVQQKALKAYKWFVG GNNFCADVYQISPRDKVYTDKKEQGSWKVEVLSNYMATLNKGQALW RKKHPTARLVMRLKIDDMVMGENFTKEEAEQKLQQEIEKWEKSKEM KKYKDKLTEWEKTHEGKEPKKPEKPKSINEIIIEKCNKEKTSSTSFLFR VKKISSDGSVYIRPDFITKEESDKKSVKLSASSYQKYKIRKVFVSPAGKL VDNGFSDKWNDTKCN |
| MG89 effectors | 11731 | MG89-2 effector | protein | unknown | MSYVLGLDLGIASVGWSIVEPGNRIIDLGVRVFKKAETDKEGDPLNLIR RESRLSRRRLYRRAHRLSRLLNFLISSGLIHSKDEVLKNVYNENPWALR TLGLNSVLTNNQLARVIYHICKHRGFYWASSADDGQADNGKIKKSLSS NQLVMKEKGYKTVGQMIFTEYPNCQRNKSGEYSKSLPRTDLDKELRA IFKAQQSFSNPIVTKDFINAIVGCGDRKTGFLWEQRPALQGEDLLKMV GHCRFEKDELRAPAANFYSEQLVWLTKINNLRVYDEDSQERPLTREER DLILNMPLEMKSDIKYSSLTSAFEKANLWKSGQFKYKSVDYEQKTQKK KNTAKSVDITKSSKKNPEDKVFYKSSHLHEIRKALGSSLSEEWEKIRTE VLSGKYDRYNRIAYVLTVYKEDSDVIEQLSPYESRTLIEALLPVRFSGFV ALSEKSLKKIIPHMVLGKRYDEACSEANYKHYKQNQAEFKKLKYLPPL FSGREPNGTLIFNEEIGDIPRNPVVLRVINQTRKVVNAIVKKYGSPKSVH IELARDLAKSRAERNEIEKRNEEAASRHIKERDEFEKLFGSKCLNGTNL LKYRLYKEQDCKSMYSSKEIDHKRLFEKGYVQIDHILPYSRSYDDSQSN KVLVLTNENQDKGNRIPFEYFEAKQHGFSWYEFEQWVKSCKNLNQKK KRNLLRCSLSKDAKKDFLERNLNDTRYACRFVKNYIDSFLCLSENSDNS GCVVVAGQLTAYLRNCWGLNKVREENDRHHALDATVIACCTRKIVQ KVGAWSKSREMNSYNSSYVDPDSPVDEDEKLLQKLYVNTRKPDFPKP |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | WECFRSEVESRVFESALEKLKEKLKLQCSYTESELKNVRTLFVSRACE<br>KIGKGALHGDTVYRQTSEMRKENVAVKKVSLKKLKYARIEAIVDADT<br>RNKNLCDALKKRYEEYARKIGKKIEDFVDKDIAKIFADDNPLHMPNSD<br>GQEDPCNPIVKSVRVKEAFSGVPIRNGVAGNSTIIRVDLFKKDGKYYCI<br>PVYAWNKTLPNRAYVSGKKETDWALVDDSFEWCFSIRQNELLKIKLK<br>GETIFGYYNGFDRDRGSFNILLHDRQDGKDHKQGLIRKGIKTAISITKY<br>DVDVLGNYYLSKPEKRLELA |
| MG89 effectors | 11732 | MG89-3 effector | protein | unknown | MDLIFGLDLGIASVGWSVVDDENKRIVDLGVRAFKAAETEDKGKSLNL<br>VRRTSRLSRRRIYRRANRLNSLLNYLIKSGLISSKDEILNNEHHENPWNL<br>RVKGLDGVLSNNQLARIIYHICKHRGFYWSSSAEETEDTEKGKIKKCL<br>AQNSLALTNEHFRTIGETILNKYPDAQRNKADEYTKSISRVLLNEELKQ<br>ILTVQKEVFHNPLLTDDFFKAILGTGDKKSGFLWKQKPPLQGEQLLK<br>MVGHCRFEKDELRSPKANYFAERHVWLTKLLNLRIYSEDCEDRALTV<br>EEISIVINKIYEQKSDIRYSSLTTAFVKSGIWPKNHQYKYKGLNYDQLTS<br>SKKKKVEDTASTSEDSTDTKKTAKKTNPESKIFYKSSCYQNIKDAYMSN<br>SLEQEWNILSTQISQGNYDRYNRIAYILSIYKDDEEVKKHLLDCGEKSE<br>VAEALLKIRFNGFSALSEKALKKIVPIMEQGKRFDVACSEAGYAHYKQ<br>SQDSKEKRKYLPPLFSGREPNGTLIINSELDDLPRNPVVMRVINQTRKV<br>VNALVKKYGSPKSVHIELARDLSKTFEERIDIQKRQEEIKERRQKEQEE<br>FDRIFGVGIRSGKNLEKYSLYKQQDCKSIYSGETIDLGRLFEQGYVEVD<br>HVLPYSRSFNDSQDNKVLVLTKENQNKGNMLPYEYFMSHNLDWNQFE<br>ARVLSNKKLRKNKRCNLLKKSLNRNSKKEFLDRNLNDTRYACRFVKN<br>FIDKYLRLSDKADKSGCVVVSGQLTAYLRKHWGLNKNRSENDRHHAV<br>DATVVACCSRRMVQLIGYWSKHKERQYLKDSQSDPDLESDEELLLKK<br>SIGSQKLYFPYPWVKFRKELNLRVFSSDIEELKNELSLFESYTEEDISKV<br>KTLFVSRAIQKIGRGALHADTVRSQTEEMNKEKVAVSRVKLSELSYDR<br>ISKIVDSDTRNKNLCNALKRRFEAYCKSNNINEISKLKAKDSAKIFTTNN<br>PMHMPNSNGEEDPLNPVVRTVRVKETFSGVPIRHGIAGNGDIFRVDIFF<br>KEGKYYLVPIYAIAKELPNRACVAKKHESEWTVIDDTYQWCFSVTQYD<br>LIKIELKKETYFGYFNGFDRATGAVNIILHDRSTEKYKKGLIRSIGLKTA<br>KSVTKYRVDVLGNYYLAGAEKRLELA |
| MG94 effectors | 11733 | MG94-1 effector | protein | unknown | MRKKIRYVIGLDIGIASVGWAALLLDENDNVCGIVRAGVHTFDEAVVG<br>QSKITGAAYRRGYRSGRRSIRRKVNRIQRVKNLLQRLNIISKKDLEEYF<br>SGAVENIYYLRCAAIQNEPAYILNNKELAQLLIYYAKHRGYKSNTSYEQ<br>KTDDSKKVLSALSENKKYMLEKGYQTAGEMLYRDEKFRRKRYGSSEE<br>CELLLVRNSGDDYSHSISRELLVEEVHVIFARQRELGNKLTTKELEDQF<br>VEIMQSQRNYDEGSGEGSPYGGNLIEKMVGECTFEKGEKRACKASYTS<br>ERFVLLEKLNHLRIQSKNGDVRALTEEERDAIIKLAYKNKDVKYKALR<br>TILKLNPDERFGGLTYSRGDIENSTEGKSVFVSLEYWYEIKKVLGLFYD<br>DLDNEETQQLLDSIGTILTCYKSDDLRRRKFEQLHLEQEKIEHLLALNY<br>TKFQNLSFKAMKNIMPELEKGLSYTEACSNAGYGDKETIEGKNKYISK<br>ELLNNTLDSIMNPTVKRAVRRTIRILNELIKQYGSPVEVHVEMARDLTH<br>SQTVTNKMKKRQDENKAEKEEAKRFICENFGKTEAQVSGKDILRYRL<br>WKSQNQIDIYSNTMIPVSDILDYEKYEVDHIIPYSCSFNDSFNNKMLVRK<br>KDNQDKKNRTPYEYIGSDEKKWEAFATCANTYVMNYGKRKNMLTKV<br>PASNTGEWMSRNLNDTRYTTKVVTDLIRKHLKFEAYVDQKRKKHIYPI |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | NGGITAKLRYEWGLEKDREKSDKHHAQDAVVIACCTDGMIQRLSRQYMLQEIGIVTWKNHKLVDRRTGEIVEETNLPWECFREEVEMFMADSPEDYIEKAKKNGYKGEAPKPIFVSRLPQKKTTGKINEDTLRSVRIDSKGKARFVNKTKLQDLKLVEVDGKKQIKDYYRPEDDKLLYDKLLERLVKNDDAKVVFAEPFYKPKKDGSDGPIVRSVKTYGKTVKNQVLVGDGVAERGGIYRCDVFKRKDEYYAVVVYYRDLYIGNLPNNAAHFDIEMKKGEFEFSLYKDDLIRFVKDGKEQYAYYKYINANNSQITYTEHDTSKETKCTTIRTLDKFQKMNVDLLGNIYSSDKEEREWN* |
| MG16 effectors | 11734 | MG16-3 effector | protein | unknown | MATKKILGLDLGTNSIGWALIETEDSNPKSILAMGSRIVPLSTDDSTQFAKGQAITKNADRTQKRTARKGLNRYQMRRAMLTEELRRHGMLPERTDENIMDLWRLRSDAATDGKQLSLPQIGRVLYHINQKRGYKHSKADNSANTKQTKYVEAVNQRYRDIQACHQTIGQYFYEQLLSSAVQTPSGSYYTYRIKDKVLPREAYIAEFDQIMKVQRVFYPDVLTDELVDTLRNHIIFYQRPLKSCKHLVSLCEFEKRPFKREDGQIVYSGPKCAPRTSPLAQFCTVWEAVNNITLTNRQNETFEITQEQRVAMADFLNQHDKMGVKDLQKILGISPKDGWWAGKAIGKGLKGNTTFTQLREALGNLPNAEHLLKMKLSMVDAAVDTTTGELIRQVSPQVEEEPLFRLWHLVYSLQNEDELRKALRKQFGIDDEEVLDKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYENRIREYGIQPSRSRIQKYKMWEESNHLCFYCGKPVNVTDFLAGAEVEIEHIIPQSVLFDDSYSNKVCACRACNQAKGNLTAREFMEKHSKEEYDSYLRRVDDAFNAHRISKTKRDHLLWRKEDIPQDFIDRQLLQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKRAATPAKRAVYQNGKRHIVQTGLQVPRGALSEETVYGKLGNKYVVKYPLGHQSMKMDDIVDPTIREIVRTRLNAFGGKAKDAFAEPLYSDAAHQMQIKTVRCYTGLQDKAVVPVRFNAQGEPVGFVKMGNNHHIAIYRDAKGQYQESVVSFWQAVERKRYGIPVVIEQPHEVWDKLINSDNIPQDFLETLPHDDWQFVVSLQQNEMFILGMDDADFEAAMEQKDYRTLNKYLYRVQKISSKEYCFRYHTETSVDDKYDGVINKSISMELQKLKRLTSISAFFSQHPHKVRVNLLGEVSAL |
| MG2 effectors | 11735 | MG2-4 effector | protein | unknown | MNSTRSTPLVLSFDIGYASIGWSVAEVVDPANNLQAGVVTFPSDDVLNSERAGHRRARRNIAARRNRVQRLKLASVGAGFVTAEEIETLDRMERKSAPEWRHCPWFLAARVLGESPESTLTGLQLFHVLRWYAHNRGYAPPSWGLFDEADGEQEEDFEKVRNAEKAMHEFGADTMAQTWCALLDADPTAGRWPEPRHWAKGENMAFPRERVQAEVTRLLVAHVGKLPGVTSDFVRCLIDDWEHHPKIRSWLQGADPRTGKLRDYALPKRYEGGLLFGQHIPRFDNKIIPWCPFTLKEDTNSGKISGRNVPKKHSRAFLDFKVAMRLNDLALSELGESGGRLSAGQRMTLFKRIEGYGDVTVRQFADLVAEVCAIPKPDLTTRIPEREGSDRPFELRPERKALIAILTGGRSLPSWPLIHSIWDCFEDAEAVLRPVFHGKPTSWADLIEQAKAPDVLLERLEELFRLGKGKPSRSKKAQPPPDFEVLLRCKITITKAHGRARYCSDKLRAATDEALGGLDPRRAPTTETSDDAGCLYLNERQRDLQDRLPLSKLINNHLVRHRLLIFRRLLQDLVNTYANGDRERIDAIVVEVARDLNEYSGKNTKQRVALFQEKQRPFND |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | AAEAFAQALIDDAQYTPEQAQALATYANVRRFRLMREQNFECPFTGR HLSAEDIAKDRVDFEHIIPRSLKPTDSLDAMVITYRAVNQAKRNRTAMR FIKDMAGERLDADDAGWSYHTPQQFETAVNRMRPKGRLNTAAKRSQ ANRCDALLVEDYEPREADFLQRDLTQTGYLMKYAVGEARKFFRSAPR QPRFIHLEGRVTTFFKKAWRLTETLAPISPLFLREYADPRTGRWQSTV RPKAELRRFTQLHHALDALTLGLATALVPGIERKELRRALSLRQAKGD DATLLRSDPKLGEALRWRTEDRFEAAPLSGKLESAVRRALAEGRVVQ HVPAKRQGMKVDSNFFGFVEFDETGRLRVRQKMRSPTTRRREIKTTV KNGKNLHTLSHLSLDPKSWLGAPDHPLRRKQLEHGLRTENDLANPKL GNIRGMLPIRENWGIALITKDGSPRLDVIPYINVHQWLEVLALENGGGS PVVLRKGHLVGFDAEKCPEEYCGAWMLLGVKDGRSGTTLELIRPWM VAPRKGGTKESSAKQAIKPASGYSEKEGKASGVFLQRSADVFLKLGLR PLDHDLTGIAAF |
| MG21 effectors | 11736 | MG21-2 effector | protein | unknown | HNTSGVYDLTVARTFIEEEAHKLFAAQRQFGNAFATENIENEYCEILLS QRHFSDGPGGERTFKFDLRGNCTFEKDELRAFKACYTFEFFKLLQDIN HLRIIPEYRKGSNKQTRPLTPEERQKIIDLCLKSSSIDFSKLRKELKLAD DEIFNRVGYDVKKKKSKKKDAEEQPEEQLTPEQQRTKCEEATKFTQM QSYHEMRKALDKVAKGTISKFSHDKLDEIGEILSLYKADDKRRERLEQ IGLSNEEIEALLPLTFTKAGNLSLGAMRKLIPYLEQGLTYDKACEIVYG DHRAQYKGERMPLLSFGKLKEEGALDSVNNPVVLRAIAQTFKVVNAII RRYGSPQAIHIELARDMKRNFADRQDIKSKQKDNWSENNRRREKVEEI KGSVATGQDIVKMKLYEDQNGVCLYSGKQLELHRLFEVGYAEVDHIV PYSKCFDDSYNNKVLVFSSENQRKGNRLPLEYMLAEGDEDKLDDYVTL VEANIKNTRKKQRLLKPCLTEQDITDWKARNLTDTQYITKAVADILRN YLAFEEDSPFIKKPVRSINGAVTDQVRKRLGLQKHREEGDLHHAMDA AVIAVTTDGYINRISRYTQRREFGKRIGCYKDKQTGEKVEIERQKGQA PLYIDPETGEKLTEQVFDHKYAPTFPAPWKEFTKELKARMAPNADEAI RQLYLPSYGSEEIKPIFVSQMPDRKISGQAHAETIRSARIDVDESGKERII AVAKTPLTSLKLDKDGEIDGYYMPSSDRLLYEELKNRLIKTKTSGKTY GNAEQAFKEPVYKPKKDGSQGPRVYKVKTWKPTTSNVKVAGGIAKK GDIVRVDIFHITGGKDQGYYFVPIYVADTIKNTLPKHAVVTNFKSSKVE WKEMDDSNFIFSLYKGDLIHIELCADCRDKDSNNKIRKAKDMYVYYDG |
| MG22 effectors | 11737 | MG22-2 effector | protein | unknown | MKNILGLDLGTNSIGWAWIQSKVPQQTDDCPSSSEYLMPDCATIRMAG SRVLPMDGKMLSGFESGLAVSKTKERTTYRMARRVNERFQLRRERLN RVLRILGFLPAHYEACLDRYGKIDEEKNVTIPWVPTADGKRKFLFYAS FLEMKERFHEHHPNLEKIPLDWTLYYLRTKALQQAITKEELAWVLHS FNQKRGYNQSRDEVKDEDASQKEEYVKVKVVSVVDSGEKKKGKTSYI VTTESNLQFTTENAAAPSWLDKEREFIVTTKLNPTGLPKMNQEGRIDC TVRIPKEEDWELKKKRTEALIADSHMTVGEYIFHSLLDNPDAKIKGAK VGTIDRHFYKEELIAILKKQAAFHPELKDAERYAECVSALYASNEMHR NILSAWDMPRLIVNDIIFYQRPLKSKKSDIAECPFESRYFMDKEKKLQK QGIKCIPTSHPHFQEYRIWQFLSNLRVLRREVRENGRYMTDVDVSAHY LTDKVKVELYEWLAGKANVKQKELLSKLRMSEKEFRWNYVEDNIYP CGETRSLLSTRLKKAKLPLSLLDSPSSDGSHTFEFELWHILYSVSDLAEL RKALRRFARKHDFTAEQQEAFVETFVKCPPFKKDYGAYSDKALVKLL SLMRIGKYWNADRIDTNTRRRIACLLDGEACDSISLRTREKVAERGLQ |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| | | | | | QSIEQFQGLPQSLACYVVYDRHAEASEVVRWESPADLQQFTRQFKQYS LRNPIVEQVVLETLRVVHDLWEEIQKDGGTIDEIHLEMGRDLKNTAEQ RARIMRRNRENEMTNFRIKLLLQELHDCQPDIEGIRPYSPSQQELLRLY EETVWESESGKLGGKEASKDIPDDIKKIRDLLSKPSDKPIPQSAIQRYRL WLDQKYLSPYTGRPIPLARLFTADYEIEHIIPRSIFFDDSYANKVICESAV NKLKNNRLGMQFIREMDGRVETVKLGEGRETSILSVDGYVDLVNDLF RNNPRKRNNLLAEEITEDFCHRQLSDTRYIARYIKGILSNIVRQRAADG TLEQEATSKNLIVCTGQITDRVKQDWGLNDVWNHIITPRFERLNRMTG SNDYGEWCCKEGKRYFQTRVPLHLQIGFNKKRIDHRHHAMDAIAIAC VNRNVVNYLNNAAAHATDRMDLRMRICRPSGNGQTKKEIRSPWKNFA HDAECALQAITVSFKQNVRIITKATNTYEGYDASGKKVRRCQTSSDHY SIRKPLHKDTVYGEVVLPVVNQVPLKKALLRVNRIVNGKLRKKIQEM QSSGLTDKQIVDFFMKTCADSPEWNSINFKKIEVRAYSNEEGQTRMAAI RTAIDESFSEKVIGSITDVSIQRILLNHLRECNGDSEEAFSPEGIETMNRN IVRLNGGKPHLPIYKVRLGEAMGKKFAVGQRGNKGKKFVITAKNTNL FFAVYANDEGKRSFETIDLHCALEMQKQGSSVAPPINENGDKLLFVLSP NDLVYVPSESELQHDIDSEDLKLDHVFKVVSFSENRCCFVPHSMSSPIAA GFEFNSPNKIEVVSRLGLFEQDKETVSIKNICLPIKMDRLGHLHLVKI |
| MG23 effectors | 11738 | MG23-2 effector | protein | unknown | MSEKIPYYIGLDMGTNSVGWAVTDENYKILRGKGKDMWGVRLFDEA QTAAERRTNRVSRRRRQREVARIGLVKEYFADALNAVDPGFMVRLEE SKYWLEDRSEENQQKFALFNDKDFTDKEYYTVYPTIFHLRKELIESTE QHDVRLVYLAILNLFKRRGHFLNKSLESDGETMSMAEAYAALVDEAA ALEITLPMPIDAKKLEEVLSQKGVSRKFVEQDTNEFFGFSKKASEAREL VKLMCGLTGKMRNIYGEELIDDDNKKLALSFRSNDYEEKMNEVAELV GDENMRLLEAVKEVHDIALLANILSGEQYLSVARVKQYNKHKEDLQQ LKRVLRTYDKAAYKKMFRVMGKDNYSAYVGSVNYKEHKERRNAGA GKDGESFRKAVEKVIDALPEEAQLDQDVIEIREKIKNEAFLPKQLTSAN GIIPNQVHLRELKRILENASGYLPFLNEIDESGLTVKERIAQLYEFQIPY YVGPLSKQNSKNAWANRRPGEEKGRILPWNFEQKIDVNQAAEDFIKR MVRHCSYLDAEFTLPKQSLMYEKYMVLNELNNLRINGEKPTVLQKQQ IYNELFGKGKRITQKALINYLKDEGIVEKDSEPIISGIDGDFKASLSTFG KLRTVLKEEARKDSSQEMMDQIVFWATVYGDDKRFIRARIEEHYSEIL DDHAIKQLLGMKFNGWGNLSKAFLEMEGASKEDGVYRSVIQALWET NDNLMELLGQRYTYKEELEKRVQTKEKPLAEWTIDDLDGMYLSPSVK RMVWQTLKIIREITEVRGSAPSKIFVEMARDDAQTKAKNKGKRTKSRK DELLECYKDDKAWKDELTSVDDGELRAKKLYLYYLQMGRCMYSGEA IDLASLMSGNTMYDIDHIHPRHFVKDDSLENNLVLVKKDKNAHKSDNY PLESEIRNKQFGFWKSLLDKGLITKTKFTRLIRSEDFSPEELAGFINRQL VETRQGTKAITKILQQAFPDDDMEVVFTKAGVAAKLRHDFDLVKVRC VNDTHHAHDAYLNIVAGNVYNAKFTSNPLRFIKNEVKKGNASYHMDKI FFRDVKRGNKLVWQAPNNEEKTPGTIAIVREQLARRTVLQTRRSYMA HGILSDATIYSKDTAKTESYRPVKSSDERLSDVKKYGGMTSIKNTAYAL VEYTVKGKTIRSLEGVPIYLGNCSKDDKKLLQYLQEILQRENKNKQVE NVSVRMYPIRQRSYLKVDGYYYYLGGATGSSVYLLDAMSVYLSKEDM GYVKKVEKAVAQQRYDECTKEGEFVLTREKNMDLYNKLVDKFSHGV FIKRKASILKTLEEGIDVFSELNIEKQCGIIMQIFAWITTSQQNVNLTDIG GVAHAGTLLISKKLSTSREALLIEQSLTGLWSKTTDLLTV |

TABLE 24-continued

Listing of additional protein and nucleic acid sequences referred to herein not included in the sequence listing

| Category | SEQ ID: | Description | Type | Organism | Sequence |
|---|---|---|---|---|---|
| MG3 effectors | 11739 | MG3-3 effector | protein | unknown | MSADSLNYRIGVDVGDRSVGLAAIELDDDGFPLKKLAMVTFRHDGGK<br>DPATGKTPKSRKETAGVARRTMRMRRRKKKRLKDLDKKLRDLGYFV<br>PRDEEPQTYEAWSSRARLAESRFEDPHERGEHLVRAVRHMARHRGW<br>RNPWWSFSQLEEASQEPSETFGRILERAQHEWGERVSDNATLGMLGA<br>LAANNNILLRPRRYEHNPKTGKNAEKLNVRGQEPILLDKVRQEDVLAE<br>LRRICKVQGIEDQYPELAHAVFTQVRPYVPTERVGKDPLQPMKIRASR<br>ASLEFQEFRIRDAVANLRIRVGGSERRPLTEEEYDRAVDYLMEYSDTTP<br>PTWGEVADELEIAENTLIAPVIDDVRLNVAPYDRSSAIVEAKLKRKTQA<br>RQWWDDDANLDLRSQLILLVSDATDDTARVAENSGLLEVFESWSDEE<br>KQTLQDLKFDSGRAAYSIDTLNKLNAYMHEHRVGLHEARQNVFGVSD<br>TWRPPRDRLDEPTGQPTVDRVLTIVRRFILDCERAWGRPQKIVVEHAR<br>TGLMGPSQRADVLKEIARNRNANERIRQELREGGIEAPNRADIRRNSII<br>QDQESQCLYCGKEIGVLTAELDHIVPRAGGGSSKRENLAAVCRACNAS<br>KGSRPFAVWAGPARLERTIQRLRELQAFKTKSKKRTLNAIIRRLKQRE<br>EDEPIDERSLASTSYAATSIRERLEQHENDDLPDGFAPVAVDVYGGSLT<br>RESRRAGGIDKSIMLRGQSDKNRFDVRHHAIDAAVMTLLNPSVAVTLE<br>QRRMLKQENDYSSPRGQHDNGWRDFIGRGEASQSKFLHWKKTAVVL<br>ADLISEAIEQDTIPVVNPLRLRPQNGSVHKDTVEAVLERTVGDSWTDK<br>QVSRIVDPNTYIAFLSLLGRKKELDADHQRLVSVSAGVKLLADERVQIF<br>PEEAASILTPRGVVKIGDSIHHARLYGWKNQRGDIQVGMLRVFGAEFP<br>WFMRESGVKDILRVPIPQGSQSYRDLAATTRKFIENGQATEFGWITQN<br>DEIEISAEEYLATDKGDILSDFLGILPEIRWKVTGIEDNRRIRLRPLLLSS<br>EAIPNMLNGRLLTQEEHDLIALVINKGVRVVVSTFLALPSTKIIRRNNL<br>GIPRWRGNGHLPTSLDIQRAATQALEGRD |
| MG3 effectors | 11740 | MG3-4 effector | protein | unknown | MSTDPKNYRIGVDVGDRSVGLAAIEFDDAGFPIQKLALVTFRHDGGLD<br>PTKNKTPVSRKKTRGDARRTMRMNRRRKQRLRDLDMMLTNLGYTVP<br>EGPEPETYEAWTSRALLASIKLANVDELNEHLVRAVRHMARHRGWAN<br>PWWSIDRLENASREPSETFEIILARARELFGEKVPADPTLGMLGALAAN<br>NEVLLRPRDGKKKKTGYVRGTPLLVAKVRQEDQLAELRRICEIQGIEG<br>QYDALRSAIFTHKMAYVPTERVGKDPLNPSKNRTIRASLEFQEFRILDS<br>VANLRVRTDSRSKRELTEAEYDVAVEFLMSYTANEQPSWADVAEVIGV<br>PGNRLIAPVLEDVQQKTAPFDRSSAAFEKAMGKKTEARQWWESTDDD<br>QLRSLFISFLVDATDDTEEAAAEAGLPELYMSWPAEEREVLSDIDFEKG<br>RVAYSQETLSKLSEYMHEYRVGLHEARKAVFGVDDTWRPPLDKLDEQ<br>TGQPTVDRVLTILRRFVLDCERQWGRPRAITVEHARTGLVGPAQRQEI<br>LNEQKKNRENNELIRGDLRKSGVENPSRAEVRRHLIVQEQESQCLYCG<br>AVIRTDTSELDHIVPRAGGGSSRRENMAAVCHYCNSKKKRTLFYDWA<br>GPVKLQETVDRVRQLEAFKDSKKAKMFKNQIRRLKQTEADVPIDERSL<br>ASTSYAAVAVRERLEQHFNEGLAPDDKSRVVLDVYAGAVTRESRRAG<br>GIDERILLRGERDKNRFDVRHHAIDAAVMTLLNRSVALTLEQRSQLRR<br>AFYELELDKLDRDQLKPGEDWRNFTGLYEASQNKFSEWKKAATVLGD<br>LLAEAIEDDAIAVVSPLRLRPQNGSVHDDTINAVKKLTLGSAWPADAV<br>KRIVDPEIYLAMKDVLGKLKELPEDSARSLELSDGRYIEADDEVLFFPK<br>KAASILTPRGAAEIGNSIHHARLYSWLTKKGELKFGMLRVYGAEFPWL<br>MRESGSRDVLHMPIHPGSQSFRGMQDGVRKAVESGEAVEFGWITQDD<br>ELEFDPEDYIAHGGDDELNRLLRVMPERRWRVDGFYNAGTLRIRPALL |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | SAEQLPSELQKKVADKTLSDVELILLRAVQRGLFVAISSFLPLESLKVIR<br>RNNLGFPRWRGNGNLPTSFEVRSSALRALGVEG |
| MG4 effectors | 11741 | MG4-2 effector | protein | unknown | MLREPGNSVKSKIMGQQAKRRSYVLGLDIGTHSVGWALLKFRDGRPC<br>GVERAGVRIFEPGVEEVAFERGRAEPPGQKRRQARALRRQTERRARR<br>KAKLLHILQRAGLLPKGEADEILPALDRDILARHSAAWPGARDALPYW<br>LRSGALDHRLEPHEFGRALYHLGQRRGFLSNRRAPMRKNEEDGKVKA<br>GISTLKEQMEKAGARTLGEFFAGLDPHQERIRQRYTSREMYEQEFEAV<br>WSAQAAHHPAILTDDLKARVHHAVFHQRPLHNQSYLAGSCTLEPDRK<br>RTPWACLIAQRFRMLQKLNDTRVLPASGPERPLSDEERQTVLTELDRK<br>KELKFDRVRKLLGLSADSSFNWESGGEDRLVGNTTNARLAKVFGKRW<br>WSLSPDDRDQVVEDVRSYEKAEALARRGREHWGLDEKAAGELSKLSL<br>EDGYCRLSRQAIERLLPGMEKGTAYMELVRKLYPDRWAAGKPVDLLP<br>ALAETDLDMRNPVVRRCLTELRKVVNAVVRHYGKPSAIRIELARDLRK<br>SAKQREQTWRRNRRNQQDREAAAEKLLQEARIANPSRADVEKVLLAE<br>ECGWHCPYTGHGFGMADLFGPHPHFDVEHIVPFSRSLDNSFLNKTICE<br>ARENRDRKRNHTPYEAYGADAERWDQIIARVQSFRGTASREKLRRFQ<br>QHEVEDLDGVAQRELNDTRYASLLAVQYVGMLYGGAVDAGHVRRVQ<br>AAKGGTTGYLRDMYGLGFVLGEGRKERSDHRHHAVDAVAIALTDPA<br>ALKSISQAASDERRGGRVSFGAVALPWVDFIGDVQAAIEAINVSHRPSR<br>KVNGALHEETFYGPRGMDGDGRPTGYVQRKPVERLSAKEIPNIPDPAV<br>REAVQAKLDEVGGTPAQAFKDPANHPVRKRGIPVHKVRLRLNINPVQ<br>VGSGATERHVLTGSNHHMEIIEVRDAKGGKKWTGRLVHRLEAKRRA<br>LGRETIVDRAVQAGRQFQFSLSPGDMIELTGEDGERKLHVVRSISEGRI<br>EYVDARDARKKADIRASGDWRKPAVGSLLRLHCRKVVVTPFGEIRYA<br>ND |
| MG44 effectors | 11742 | MG44-1 effector | protein | unknown | MEKFYLGADIGTNSVGIACTDENYELIRAKGKDCWAVRLFDESKTAET<br>RRNFRTSRRRLERRKQRISWLQALFAPYINDETFFIRLNNSQFLPEDKD<br>EILQADKNALFGDEGYTDKNYHVEFPTIYHLREKLIEGGKYDLKLYYL<br>TIHHIVKYRGHELFEGATMEEIRDIKRLFENLNAVWEATYAENVPHINL<br>AKSDEAKEILLDTKKGLRDKQIALEKLFGENTALMKESIKAMLGGKIS<br>PETLFGEEYKDEKSFSFKDMDEEAFDALQSTYGDNFECLNALRSIYNFV<br>AFEKLLCGHKNISSAMIAVYNKHAADLSLLKSFIRSERPNDYNKIFKSTT<br>EKANYVNYIGYTKKGGEKKKVAKCKSDDEFFAYMKKYLSSLDDIKDG<br>ATRDKILGEIENGSFLPKILHSDKGLFPRQVNEAELKAIASNMVKYYPE<br>TKEIADKIIPLFEYRIPYFVGPLAGVNSWAVRKSGEITPWNIGEKIDLAA<br>SNEEFMRKMTSKCSYIFGEDVLPKCSIIYQKFDVLNQLNKLRVNDRPLT<br>VDLKKGIFNELFLKYPKVSDKKIKDYLIRNGHFSPTDGEITLSGKDGEF<br>KASMSSYIQLKRILGDFVDKDLENGGEVCENIILWHTLNTDKKIVYDLI<br>EKRYKNIPEIADSVKALKGLSFKNFGRLSKKFLVDLYSADNETGELVNI<br>LDVLYETNENLNEILNDEKYAFGKLVDEANGVADSKITYEDIEKLYVSP<br>AVRRGIWQTVTMIDEYVEAIGRTPDKIFVEVTREDGVKGDAGRTQPRK<br>RQLQEKYKNVSKTYADVISELGDEKYSDMKLRQERLFLYFRQLGKCM<br>YSGQRIDLDRLDTDTYDVDHILPRTFIKDDSLDNKVLVLRSKNAEKADR<br>YPLPQGFSDQQDFWKMLLDKNLIAKTTYDRLTRTEPLGDNDYKDFINR<br>QKVITDQTVKAVAELMKRKYPTAKIVYSKAKNVNDFKNKFDIFKCRET<br>NDLHHARDAYLNVVVGNVYDTVFSNPLDMFRKDGDMWRTYNLKKLF |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| | | | | | TRDVKGAWDCSRIARIKSICGSHTMAVTRYAYCNKGEFYNQTVYGKD DAGVSSPRKSNGPLSDTKKYGGYKSQTTAYFAIVSSLDKKDNRVKTIEA VPVLVAYRLKNNPKAVEEYFNSYLKSPEVLIPKIKNKQLVSYNGSLVYI AGVTGDRISVHNATQLFTDNKMDEYVNGLLKLLDMDAKKMLVGDEP RYVIKTNRNKEEKLVIDKEKNVELYGYLKNKLCDKIYSGLSAFATFAK NIENGKEKFIDLTIVEQAKVLIQILMMFKRKDILSDLTLIGGSSHSGKIL FNKKIDDVNFEIIHLSPAGLRVIKNKV |
| MG46 effectors | 11743 | MG46-1 effector | protein | unknown | MKENYYLGLDIGTNSVGYAVTDGGFNLLKYKGEPMWGSHVFEEGKQ CSDRRMHRTARRRLDRRQQRVHLTQEIFAKAISEVDERFFVRLKESAL FREDTSGRDTYIFFQDENYTDKEYHRDYPTIHHLIKELMEDTTPHDVRL VYLAVAWLMAHRGHFLSEVNKDNITELLDFDSIYGNLMELFTTPPWIC SDKEEFKNILLLHQTIKNKERKFWGLLYEGKKPKTDEEDYINKEGMIR LLSGGTVEAGKLFNQKEFQEKISISLKKSEEDFQLLLDEMDEEDSEYLI RLRALYDWALLVDSLHGCSSISEAKVQDYAQHEADLKMLKNFVRKYC PNEYAAIFKNAEKENYASYVYNIPKGKRTKEYKKKITQEEFCDYLKKK LKDIQIEEEDQEIYQDMMFRLETYTFMPKQVTGDNRVIPYQLYYDELK KILENAENYLPFLKKVDEQGISNKTKLLSIFEFRIPYYVGPLCSASKYA WLKRKAEGKIYPWNFEEKVDLDQSEKAFINRMTNNCSYLPGETVLPQ NSLLYCKFTVLNEINNIKINGIPISVECKQEIYRLFEENKKVTVDKIKKY LISNNYMEKEDVLGGIDITIKSSLKPQHDFKRLLHSKILNEKEVEQIIECI TYSEEKSRVLRRLEREFPKLSDEDRRYLSKLKYSGFGRLSREFFTGIHG ANKETGESFSIIQALWDTNDNLMQLLSDRYTFKDSIEEEQRQYYEEHP MTVESLLEEMYVSNAVKRPIYRTLDVIKDIQSVCKAAPKKIYIEMARG QEEGSNRKRSRKDQILELYKNMDKGEVRELSKQLEDCSDRELRSEVLF LYFMQLGRSMYSGKPIDIEKLKTNAYDVDHIYPQCRVKDDSLSNKVLV LSEENRAKGDKYPISAVIRQNMGEMWRVYHEKGLISDEKYRRLTRVS AFSNAEKMEFINRQLVETRQSTKALTRIFRYIFPETEIVFVKAGLVSDFR NEVLKCAKSRIVNDLHHAKDAYLNIVAGEVYHARFTSKFFKIDQDEYS VKTKAIFGNKVWNGKELVWDGEKDIARVKKILTKNSVHYTRYAFERK GGLFDQQPLRAASGLIERKAGLDTEKYGGYNKSTASYFLLVKYAEAG KKPKQDVMFVPIDLMESEQIIKSESYAKYYVRNAIAHIIGKSREIVQEVS FPLGMRKMKVNTLLTLDGFEAILASKSNGGKTLVFGSMMPLFVNNKK EIYIKRLESFSKKKKQNNFLFVDEVYDKITKEENRELFLFLINKVEEEP YCLIFGSQLQVLHDKENEFENLNLEQQVETLLNLLSIFKTGRTTGCDL KLLGGAGQAGIFTESSKLSNWKKSYKDVRIVDISAAGLHRKTSQNLLE LL |
| MG6 effectors | 11744 | MG6-3 effector | protein | unknown | MKKVLGIDLGVASIGWGIIETDEKNENGRILKSGVRIFQGNEQRADAA PGESSNADRRNKRSVRRQRDRRTRRKINLYVTLKKNGLAPNKSEWDK WVSINPYTIRAKALDEKVSLHEFGRALYHLNQRRGYKSNRKAGSDKE GAVKEGISKVRNHMAKHNARTIGEYFHEIYDNHLQNDTEHDDFDWRI RDKYTHRKMFKEEFDALWDAQSVFHKELTNDLGEVLKKIIFHQRKM KSQSHLIGKCELETDKKRIAKAHLLFQEFRVLKNINNLSISDENGFPIKL TEGDRKLFKEIFDKKDKVSWSQLKTALINSGTIGNKNAVFNLERGGRK NIEGNRTNAALSHKKAFGEKWYELEDDFKKHVVDVLIHVDKPEIVKNL ALNKWDRTEEQAEYITHKLTLEQRYGGFSEKAIKKLLPYLKKGMEES SAIKKAGYSLFEQNPGKMNQLPMPDQTIKNPVVYHALIELRKVVNGIIR |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | EYGMPDVIRVELARDLKAGYERRQKMTKKMRELEKKNDKAYKALQ KEPFNIQYPGYNDIIWFNLWEECDKTCPYTGKTIPAEAFNSGEFQIEHIL PFSRSLDNSYANKTLCEADFNRKKGNRTPWECVEAGIMEEDTMLQRIR NLPWNKRNKFTQKEIDEDKFLNRQLSDTRYISKEASSYLKHLSCERVE VVKGQTTSLLRHLWGLNGVLNKEGPDMKNRDDHRHHAIDAIVVAFTN RSTLKRLSDENKRIGTAEWMDADESGRATNDEIKRRLGGRIDLSEPWP TFRNDVEVSINNITVSHRVNRKVSGALHEETYYGPTDEPAPKNKEMMV LRKSVHQLSKKDLGLIRDETIRQIVNDEVQKRMDNGESQANAIASLEA DPPFIISPKAKVPIRKVRLLMKKDPQIMHYFENKNGEEDRAALYGNNH HIAIYETSDKNGVKKQIGIVIPMMEAARRVKDGDPIVMKDYRPDHTFL YSLAKNDMIFNHEDEQIYRVQKINSDGTIMFRQNNVAMKGQSDPGVYF KSGSRLGASKIKISPIGEIFPAND |
| MG6 effectors | 11745 | MG6-5 effector | protein | unknown | MDSYTLGLDIGSNSIGWSLIKEDKNPTIIDIGVRVFPEGIDRDTKGAEISK NKTRRNARSSRRMHQRRSYRKSKLVKISREQGILPQEDKELDKLFLKD PYELRAKGIDEKISLFEFGRALFHLNQRRGFLSNRKSGKSKEDGVVTKS ASELQSTIKKTGCRTLGEYLNKLDSTEERRRSYYTFRSMYEEEFEKLW EKQKEFYPKILNDDLKKVIKDETIFFQRPIRWDRDTIRDCDLEPGEKVC PRSDWHARRFRILQDINNLEIYNTDGSSDKLSDERRKVLLEELLNKKD MTFGALRKKYGLFESQTFNLEEGSADKKKAKLKGDEFAAQMRSAKIL GKKGWEKLNESQRIEINDLIVDDDIEDNELVKILIDKYRFSQTQAEATL DISLPSKYSSFSKVALQKLLIYMEKGKLVHEAIQAVYGKPQAITNKGEI MDFLPMPEDLRNPIANRGLFEVRKLVNAIIREYGKPKKINIEMAREVK GSKRERDEIHLKQYKNERINEEARKTLIDDFKIPNPSRDDIIKYKLWVE CNKVCPYTGKSISQHQLFGPNPEFQIEHIIPYSRCLDDSYMNKTLCFVD ENKEKGNETPYEYYSEKIPKQYEQILQRIRTLPYPKRRRFSQQEVKLDN FIERQLNDTRYISREVVKYLKKLGVIVKGTRGQVTSELRHQWGLNNIL DLAGEGLKNRDDNRHHSIDAAVTAVIGNEHLRELARTKFRKNNKEFK QPWPDFREELEEKIKHINVSYRVQRKVSGALHEETSYGPTGRKDEKGQ DIFVYRKKLEDLTISMVNKIVDLVVRDIVKKRLVERGIDPEKDKKIPKE VWNEPLYMKTTKSDKKVQIRKVRIQDVFNNMIMLKDKKGKPCRAVA PGNNHHIEIFEYKDKKGGKKRDGRVITMFDAVQRSQKRESVVKRDYG DGKEFVCSLATNEMFIMDNVDGNTELYRIQKITQSGNNKTIILRPHTYA GKLSDSDKPPLIQRKSPNTLKGHKVTVDMLGRFHMAND |
| MG7 effectors | 11746 | MG7-1 effector | protein | unknown | MSNKTILGLDLGVSSIGWAIIERNDENGRIVKSGVRVIPSSKSELSVFKD FDKGKPASFSKERTEKRGIRRSYFRKKLRRAKLIEHLKENNMFDPELL GPKYSIDVWEWREKATKEKITLAQLGRVLLHINQKRGYKSNRKAIVD EESDSNWLNAINDNSKLLREKGITVGEYFYQEGKLHERKPKVKFALHF RMKVRIFNRKDYLDEIEQIWKKQSEFYPELTDELKESIIDHTIFYQRPL KSAKHLLSECRYEKMHKVIARSNPLFQLFRVLEKVNNLRAEDAFGNNR EITDEEKLKIIEACTSAQSWKLLDKKKNLSKSKIKSILGLGKDYEINLDS IEGSKTLHSIWEVLMKSWGEAGDWIDFDWSIQGNDFSKQKSYQLWHA LYSIDEPQYLRKKLCEGFGFDLDTARLLMNIRLESDYGALSARAIKRIIP ELLKFPKDATKAIENAGYKFTDSETKEERESRELKDRIEHLKKGALRN PVVEKVLNQLVTLVNAIYAHPELPNPDEIRVELARELKSGAKERRRAE LGMARAAKDNDRIRELLQTEFGIPYPGRRDILRYRFWEEQDMRCVYS GDVIPRNKLFVGEEYELDHIIPRARLENDSNSNLVLVKSSENKDKSDMT |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| | | | | | AADYMKSKGEKAFEEYLVRVKNLYDKGAKKKAGERGSGINKGKRNF LIMKKEEIPQDFIERQLRESQYIVKEAVKLLKEVCRDVTTTTGKITDLL KHQWGANDVFRNIQVPKYRKWGMTETIVDRKTGEVIERIIDWSKRKD HRHHALDAIIVACTRQSYIQQLNRLNVLYENDYESLKSYRKFELPWPSF HNDLISSLESLLVSFRNKRRVATMNKNRIKVGGKKKYIVQKTLTPRDA FHLETTYGRRLVNNYKLVKLNKKFSMELAELVIDPDLKEKILNRLMEF GNDPQKAFANLKKNPFKWKNENLEEVLIYDEVFTTRKKLDEKENNPSE IIDPEVREIVTQRLKEFDNNPKKAFADIENKPVWYNKDKQIRIKTVNTR AKASDLYPVRTKENGNPKDFVFTRNNHHITVYQKEDGKYYDKVTSFW EAFELKKAKMPIYKENDDAAKAVLHLKINDMVLVDLNPEDLDQNDPE FFNTLSEHLYRVQKLASGDVTFRHHLETELSNKNTEVRVTNAESLYNR VVMYPLDVLGLPK |
| MG71 effectors | 11747 | MG71-1 effector | protein | unknown | MDNLILRREKMLVTKIKNTYPQISDDEIKAIKKLKYKDWGRLSATLLN SSTIAYEDKAFGELVTIISALRHTNKNFMELLSSYCSYDFIGKIKEFNGS RQSSNGKLTYKDVEELYVSPSAKRSIWQTLTILEEIKKIMGCEPKRIFIE MARSKEESKRTDSRLKKLQDLYKKCREENIDFMPRKDEFNALKTQLSS KKEEDLRSDKLYLYYTQMGRCMYTGERIELASLYDNNLYDIDHIYPRS KTKDDSLSNRVLVKKQVNAAKTDIYPLDAAIRTKMHSFWKLLYDKGFI DERKYERLTRSTQLRDEELAGFISRQLVETRQSTKAVAAILKTAYQNSE VVYVKAGNVSDFRQQFKFVKCRDVNDLHHAKDAYLNIVVGNCYHVKF TANPLNFITKNQDNRRYSLKPEIFYKFSIKRDGEIAWLGGEDGTMATV ARTMHKNNILFTRQPLEGKGELFKQNPLKAKSGQLPLKAGLSVEKYG GYDSLTTAYFALVKSEGKQGSVQLSIEGIPLVYAKQGEKAVQDYLTEV VQLCKPEIKIPKIKKYSLFKINGFPMHISGRTGKQLVFYGAGQLCIADD VADYLKKALKHETDIAEKEKTLADQNADDIQKQKAQKGLDFYEQKW GISGAVNVQLYDMFIAKSANNLYKNRPASQTITLKEKREHFVKLTLSK QIHIIKEILNLFKCASASADFKLIDKGTSCGTLKISNNITKLKECILINQSP TGVFEQEVDLMKL |
| MG99 effectors | 11748 | MG99-1 effector | protein | unknown | Same as SEQ ID 11716 above |
| MG112 effectors | 11749 | MG112-3 effector | protein | unknown | MGYNKVVLGLDVGVGSIGWGLVQLDEEKYADEKQDGTVEEKYKITD GKIIAAGVRRFQLPQDRQKKSLALIRGTARRSRRTIKRRARRLKRLIEL GKEFNLLGNDFDRDKFLIPKKGDKKEKWDTWRFRKEALERKLTDEEF FRVLYHIAKHRGAYFQTRAERLELEKDSKAAKDQGEKGEEKQDNEKK KEREKMKKGLKRIQELLKRSQYKTVGAMFYEMFKNGRKRNAPDKYS NSIRRELLHDEINEIFKAQRALGNEKADPDLEKQYLRAVLMQEKGPDD EKMQKMIGRCEIIKELCSQAGKECTADCPDLNRCRCAPKESYTAERFV LFNRLNSLKIIGGQAIDLAKHRDNIEKLAYTHDKIDFSQIRKELCLTDKP HLRFNLCSYSEKNPEYEKTLKYEVSNGQLQFGPEHRVQMDNFDTGET KVFDKEIRAIFQKRLATTPNYKKINVRYSDIRKELQGPQVDLAGFKFTA LKKEYTKSSAQLESEFFTKPKNKGKNFNGDAAYIKQFEDDAIFVELKG YHKIRKVLENRDGTWEKLKSDGTRIDTIAEALTYCKKDETRTAYLKER GITDESVIDAALTLNMEKIATYSKEAMVKLLEHMEKGLLVNDAKARC GYDKFEHKKQAYLAPYSGFFENNPVVARVIAQTRKVVNAIVRKYGEQ YPIDQIHIEVATELANSEKTRKRIKDAQDKNKDEKSRARSICEEFGINSD EGQNLTMVRLLDEQGHFCPYTGKAIVLRSTGAANEVHINDCEIDHIIP |

TABLE 24-continued

| Category | SEQ ID: | Description | Type | Organism | Sequence |
|---|---|---|---|---|---|
| Listing of additional protein and nucleic acid sequences referred to herein not included in the sequence listing | | | | | |
| | | | | | MSRSENDGMNNKILCCAKANQDKRNRIPFEWFEETHGPNSQQWFEFT<br>RRVEKMYDVPYSKKKNLLRKSWTDEEMKKFMDRNLNDTRYATRHIA<br>DYLRKYFDFSNRRDDIKDVSRIKLRSGGVTAFLRYLCGLNKNRDENDL<br>HHATDALITACATDGHVFLVSNLSKQIEEKGKNWYKHFGMEKFKPLR<br>PWETVREDILEATQKIFVSRMPRHKVTSAAHEDEVWSFDEKKRTKKA<br>QKKKKSSIPKDTARVMKINNGYAKIGEIVRADVFEDGKHKNYVVPIYA<br>VDIFSKKPLPDKYLKKNNTPYDEWPSAAADNLTFKFSLFKDDLITINGT<br>PYYVDFVEGTQANIKVRNINGSKFESTNEKTRKFGYRNIELKKFSVDM<br>LGNYKEVKEEKRLGNEGVKWTKKRPKK* |
| MG123 effectors | 11750 | MG123-1 effector | protein | unknown | MRILGLDLGIASCGWALIDQAKDGEEGRILALGVRCFDAPEDSKDRTP<br>NNQARRQHRGLRRVLRRRRQRMQELRHLFLAHGLLASAGPDALALP<br>GIDPWAMRAEALDRALAPCELAVALGHIARHRGFRSNRNQRSNEAED<br>RTMLAAIAARQERTGHYRTIGEAFARDPEFARRKRNRDGDYGRSILRE<br>EHEREVRLIFARQRALGSQCATEALEQAFTDIAFFQRPLAASEDRVGPC<br>PFEPGERRSARFAPSFELFRFLARLTTLRIGTRREERALTAEEIARAEQG<br>FGTQQGMTFKRLRKLLNLAEAEGFIGISPEDEGRDVVNRSPGNGCMR<br>GSAALRQAIGEGAWLRLLSTPERLDAIAFVLSFAAAKEFPERLAALGIE<br>EDVIAAVLAGVEQGMFDHFAGAGHISAKACRKIIPGLRRGLVYSEACQ<br>EAGYDHARRPETSLSDVANPVARKAIGETLKQVRAIVAEYGLPERIHIE<br>LARDVGKSAEERAEIARGIEKRNRERDRLRRIFVETVGREPAGSEDML<br>RFELWLEQAGRCLYTDHCIPPDAIVAADNRVQVDHILPWSRFGDDSFA<br>NKTLCFATANQEKRGRTPFEWLGADQERWNRFVAVVEGCKGMKGR<br>KKRIYLLKDAVSSEEKFRTRNLNDTRYAARIVLEHLAHFYPEDGSRRVF<br>ARPGALTDRLRRGWGLQDLKKKLEPDGEKRHEDDRHHALDALIVAA<br>TSESALQRLTRAFQEAETRGSHRDFSALTSPWPGFVDQAQEAFKTILVS<br>RAERGRARGEAHEATIRQVRKDEDGPVVYERKSVEALTEKDLARVKD<br>PERNAALIESLRAWIAAGKPKASPPLSPKGDPIAKVRLRTDKKPAIEVR<br>GGVAERGEMVRVDVFRARNRHGRWEFYLVPIYPHQVADKVRWPTPP<br>DRAVQGNTPEEQWPVMDAGYEFLFSLHQRSFIEVEKRDRTVITGYFM<br>GLDRHTGSIAISTPHSTKALARGIGARTLMRFEKFRVDRLGRTFAVRQ<br>ETRTWHGVPCT* |
| MG124 effectors | 11751 | MG124-1 effector | protein | unknown | MTLTLGLDIGTNSIGHALVETDEQGNVISLKHIGVRIFSDSRTDKEKKP<br>LNEARRTARQARRQRERKKSRMKAVLRVLREHGLDPQDSLLESPYAA<br>RAAALTGPLSRSQVGRAIWHIAKHRGPRLVRKDDKEQGVIKEGIRSLE<br>TEMLAQKARTYGELLERIRLNGGSVRLRANSEGSYNRYPSRQVMEAEF<br>NHLWESQVPHHPEVMTEALRERLITAIFYQRPLKPVYPGRCTLEPDEY<br>RMPKAMPMAHEFRIRSEVANLTLKQGDEVRTLTANERQIVVDGLLNS<br>EKLTFTAIAKLLGFRAGVKFNLEGDDGDGGKARNYLIGDLTSSKIRSV<br>WPNFSKMPENMRLSLILALLDIDDELELKCKLRSDFGISPEVVDQLSSL<br>MLPAGYINLSQKAVRAVLPYLQQGMGYAQACAAAGYHHSDHRPEEL<br>TPILPFYNELPGMKRYLGQEQKGKPGRISNPTVHVALNQVRKVYNTLV<br>EVFGVPDCVNIEVTRELKQTAKQKIAANKQNAANKKVRDAFKEKFPE<br>RANSDQDLVRWRLWNELPEERKVCVYSGKEITLNDLFSPRVEIDHIIPH<br>SISFDNSPSNLVLCAQGANRLKTNKTPHEAFAPGLHKEFNWSAIEQRVF<br>ELAADKCGTWAKKKLRFKPDYLDVGGDFATRQLNDTAYLSKVVRIYL<br>GHSCPKVLAVRGAVTAICRKEWGLDRLLRDTVSDHADLFCLSSVKSTG |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | VFMAPHHVTGGSHDIREDCSVNKLLKFGAEVVRVDPIGRFQTPGEIRRIEPRGPKVNFQNLRTTTRKPLTSLTANSISQIKDDGLRTKITAHIKEVNPKLLTDTLNREAKVELSRLLGEFGQKHSVGRVRIVANKSGVIVRHGAANQHTKVLIADTNHHGDVVVRDGKVKMLLTTYAELNHPPEVEAGWTLKMRLHKGDMIRVPGYVYNKYPKKPNYGKDRSDHRHHAVDAFVIACITPSLLRKISRSIALSKYNQLHEFPEPYERFKQELKTHLRKLVVSNKLDHSISAPIFTETNYGFTA* |
| MG125 effector | 11752 | MG125-1 effector | protein | unknown | MRPYGIGLDIGISSVGWAAIALDHQDSPCGILDMGARIFDAAENPKDGASLAAPRREKRSQRRRLRRHRHRNERIRRMLLKEGLLSEAELTGLFDGALEDIYALRTRALDEALTKQEFARVLLHLSQRRGFRSNRRATAAQEDGKLLDAVSENAKRMADCGYRTVGEMLYRDAVFAKHKRNKGGEYLTTVSRAMIEDEVKLVFASQRRLGSAFASEALEQGYLDILLSQRSFDEGPGGNSPYGGAQIERMIGKCTFYPEEPRAARACYSFEYFSLLQKVNHIRLQKDGESTPLTSEQRLQLIELAHKTENLDYARIRRALQIPDAYRENTVSYRIESDPAAAEKKEKFQYLRAYHTMRKAIDGASKGRFALLSQEQRDQIGTVLTLYKSQERISEKLTEAGIEPCDIAALESVSGFSKTGHISLRACKELIPYLEQGMNYNEACAAAGIEFHGHSGTERTVVLHPTPDDLADITSPVVRRAVAQTVKVINAVIRRYGSPVFVNIELARELAKDFTERKKLEKDNKTNRAENERLMRRIREEYGKMNPTGLDLVKLRLYEEQAGVCPYSQKQMSLQRLFEPNYAEVDHIIPYSISFDDSRRNKVLVLAEENRNKGNRLPLQYLTGERRDNFIVWVNSSVRDYRKKQKLLKPTVTDEDKQQFKERNLQDTKTMSRFLMNYINDHLQFGVSAKERKKRVTAVNGIVTSYLRKRWGITKIRGDGDLHHAVDALVIACATDGMIRQITRYAQYRECRYMQTDTGSAAIDEATGEVLRIFPYPWEHFRKELEARLSSDPARAVNALRLPFYLDSGEPLPKPLFVSRMPRRKVSGAAHKDTVKSPKAMAEGKVIVRRALTDLKLKNGEIENYFDPGSDRLLYDALKARLAAFGGDGAKAFREPFYKPRHDGTPGPLVKKVKLCEPTTLNVAVHGGKGVADNDSMVRIDVFRVEGDGYYFVPIYIADTLKPVLPNKACVAFKPYSEWRTMDDRDFIFSLYPNDLIRVTHKSALKLSRVSKESTLPESIESKTALLYYVSAGISGAAVSCRNHDNSYEIKSMGIKTLEKLEKYTVDVLGEYHKVEKERRMPFTGKRS* |
| MG125 effector | 11753 | MG125-2 effector | protein | unknown | MLSYAIGLDIGISSVGWATVALDGEDRPSGIIGMGSRIFDAAEQPKTGDSLAAPRREARSARRRLRRRRHRKERIRALILREGLLNETQLAALFDGQLEDIYALRVRALDEAITAEALARIMLHLSQRRGFLSNRKTAASKEDGELLAAVSANRARMQAHGYHTVGEMLLKDESYREHRRNKGGAYISTVGRDMIVEEVRQIFAAQRTFGNVAASEALEANYLEILLSQRSFDAGPGEPSPYAGSQIENMVGKCTLEPDESRAARATYSFEYFALLEAVNHIRLTGAGVSAPLTAEQRERLIALAHKTADLSYAKIRKELNIPAEQRFNAVSYGKSDSPDEAEKKTKLKQLKAYHQMRGAFEKASKGSFVLLTKEQRNAIGQTLSIYKTGDNIRRSLRDAGLSEEQIAIVEGLSFSGFGHLSVKACDKLIPCLEQGMNYNDACAAAGYAFRAHEGQEKKKLLPPLNAEAKDTITSPVVLRAVSQTIKVVNAIIRERGGSPTFINIELAREMAKDFSERTQIKHEHDENRKQNERLMERIKNEYGKSAPTGLDLVKLKLYEEQAGVCAYSLRQMSLEHLFDPNYAEIDHIIPYSISFDDGYKNKVLVLAKENRDKGNRLPLEYLNGKRREDFIVWVNSAVRDWKKKQRLLKEHITQEDEAKFKERNLQDTKTASRFLLNYIADNLAFAPFQTERKKHVTAVNGSVTAYLRKRWGITKTRANGDLHHAVDALVIACTTDGLIQKVSRYAQYQENRYSADGGLVVDLHTGEV |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | VAQFPEPWAHFRQELDARLSDDPARAVRGLGLAHYATGEIRPRPLFVS<br>RMPRRKITGAAHKETIKSPRALDEGLLITKTPLDALKLDKDSEIAGYYK<br>PESDRLLYEALKERLRQFGGDGKKAFAEPFRKPKHDGTPGPLVTKVK<br>LCEPTTLSVAVHGGLGAANNDSMVRIDVFHVEGDGYYFVPIYIADTLK<br>PELPNKACVAGKKPSEWKRMNPNDFVFSLFPNDLIYVSHRKGICLSLV<br>NKESTLPASREEKCTFLYLVKGKSSTASLECRNHDNTYHIKSLGIKTLE<br>KIEKYTVDVLGEVHKIEKEPRMPFTNMEG* |
| MG125 effector | 11754 | MG125-3 effector | protein | unknown | MYPYAIGFDIGITSVGWAVVALDGEDKPFGIINMGSRIFDAAEQSKTGA<br>SLAAPRREARSMRRRLRRHRHRLERIRHLLVAENVISQAELDALFEGK<br>LEDIYTLRVKALDTAVSHADFARILLHIAQRRGFKSNRKSSTSKEDGEL<br>LAAVSANRALMAEKGYRTVGEMLLKDPQYSGSKRNKGGKYLATVGR<br>DMVEEEVRAIFKAQREQGQAFAATELEEQYLEILLSQRSFDEGPGEGS<br>PYRGSQIEKMIGKCTLEAGEPRAAKASYSFEYFTLLQNINHLRLICGGE<br>SRPLSDAQREFLIALAHKTKDLNFSRIRKELDIPADTTFNAVSYKSADGY<br>EDAEKKAKFCYLKAYHQMKAAFNKLSKGHFDSLARQQKNELGRVLS<br>TYKTSANIRPRLAAAGLSEMEIDIAETMSFSKFGHISVKACDKLIPFLEK<br>GLKYNDACAAAGYDFKGYDSETRTRLLHPTEDDFADVTSPVVRRAISQ<br>TAKVLNAIIRERGNSPTFINIELAREMARDFTERSKMKKDMDENHARN<br>ERIMERIRTEYGKEHPTGQDLVKFKLWEEQHGECAYSQKHLSLKHLF<br>DPDYAEVDHIIPYSISFDDGYKNKVLVLAEENRNKGNRLPLLYLQGERR<br>ADFIVWVENSIHDYRKKQRLLKETITAEDEKGFKERNLQDTKTMSRFL<br>LNYISDHLEFSDFSTGRKKHVTAVNGAITSYLRKRWGIAKIRENGDLH<br>HAVDALVVVCTTDGMIQQLSRYSTLRECEYVQTEAGSIAVSMHTGEVL<br>KRFPYPWPEFRRELEARLGDDPRRAVISQRFPVYANGDIPVRKLFVSR<br>MPRRKVTGAAHKETIKSPKALNDGIVVVKRALTDLKLDPKTGEISNYY<br>MPQSDRLLYEALKEALKKHGGDAAKAFAAPFHKPKSDGTPGPVVNKV<br>KLCEPTTLNVAVLNGAGVADNDSMVRIDVFRVENDGYYFVPIYIADTL<br>KAELPNKACTRGKPYAEWREMDAEDFLFSLYPNDLIRVTSQKGLTLSK<br>AQKESTLPDTYETKQEMLYYTSASINTAAVACRTHDNSYEIKSMGIKTL<br>EKLEKFTVDVLGEYHKVEKEPRMAFCRK* |
| MG125 effector | 11755 | MG125-4 effector | protein | unknown | MRSYAIGLDIGITSVGWATLALDGNENPCGIIGMGARIFDAAEQPKTGE<br>SLAAPRRAARSSRRRLRRHRHRNERIKNLMVSKGVLSSDELETLFDGR<br>LEDIYALRVKALDGKVSRSEFARILLHLSQRRGFRSNRKNPSSKEDGAL<br>LKAVSENAERMEKHGYRTVGEMLLCDEAFKQHKRNKGGNYLTTVTR<br>DMVADEARAIFAAQRSFGSEYASEEFENEYLEILLSQRSFDEGPGGNSP<br>YGGSQIERMIGRCTFFPEERRAARATYSFEYFSLLQKVNHIRIVINGAA<br>ERLTAEQRNTVIELAHTTKDLSYAKIRKALKLSDGQLFNIRYSDKASAE<br>DTEKKEKLGVMKAYHQMRSAFEKQSKGRFDFVTTPQRNDIGTALSLY<br>KTSDKIREYLKDSGFDEIDMDAVESIGSFSKFGHISVKACDMLIPFLERG<br>MNYNEACAAAGLNFKAHDTGEKTRFLHPTEDDYEDITSPVVRRAISQT<br>VKVINAIIRKEGGSPTFINIELAREMAKDFTERNKLKKENDENRAKNEK<br>LLERIRTEYGKSDPSGLDLVKLRLYEEQGGVCMYSLRQMSLEKLFSPN<br>YAEVDHIVPYSKSFDDSRKNKVLVLTEENRNKGNRLPLQYLTGQRRDD<br>FIVWVNNNVRDYRKRRLLLKETLTDEDELGFKERNLQDTKTMSRFLL<br>NYISDNLEFAESTCGRKKKVTAVNGAVTAYMRKRWGITKIREDGDLH<br>HAVDAVVIACTTDGMIQRVSKYARLRECRYMPTEEGSLVIDDGTGEVL |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | HQFPYPWRDFRKELEARIGTDPARTINDLRLPFYMSSGMPLPEPIFVSRMPKRKVTGAAHKDTVKSPKELDKGCVVVKRPLTDLKLKDGKIENYYNPQSDRLLYDALKKALIEHGGDANKAFAGEFHKPKSDGTPGPIVSKVKLLEPTTLNVPVHGGAGVADNDSMVRVDVFLTKGKYNLVPIYVADTLKPELPNKAIAAHKPYSEWPEMSDDDFIFSLYPNDLVCVTHKKGIKLTVTNKNSTLPPTVEGKSFMLYYISTNISGGSIKGITHDNTYEIGGLGAKTLEKLEKYTVDVLGEYHKVGKEVRQPFNIKRR* |
| MG125 effector | 11756 | MG125-5 effector | protein | unknown | MRPYAIGLDIGITSVGWAALALDADENPCGIIDLGSRIFYAAEHPQTGESLAAPRREARGSRRRLRRHRHRNERIRSLMLEERLISQDELETLFDGRLEDIYALRVKALDEIVSRTDFARILLHISQRRGFKSNRKNPTTKEDGILLAAVNENKQRMSEHGYRTVGEMFLLDETFKDHKRNKGGNYITTVARDMVADEVRAIFSAQRELGASFASEEFEERYLEILLSQRSFDEGPGGNSPYGGSQIERMVGRCTFFPDEPRAAKATYSFEYFTLLQKVNHIRIVENGVSSKLTDEQRRIIIELAHTTKDVSYTKIRKALKLSDKQLFNIRYTDNLPAEDSEKKEKLGLMKAYHQMRSAIDRISKGRFAMMPRAQRNAIGTALSLYKTSDKIRKYLTDAGLDEIDINSADSIGSFSRFGHISVKACDMLIPFLEQGMNYNEACAAAGLNFKGHDAGEKSKLLHPKEEDYEDITSPVVRRAIAQTIKVINAIIRKEGSSPTFINIELAREMAKDFRERNRIKKENDDNRAKNERLLERIRTEYGKNNPTGLDLVKLRLYEEQSGVCMYSLKQMSLEKLFEPNYAEVDHIVPYSISFDDSRKNKVLVLTEENRNKGNRLPLQYLKGRRREDFIVWVNNNVKDYRKRRLLLKEELTAEDESGFKERNLQDTKTMSRFLLNYIADNLEFAESTRGRKKKVTAVNGAVTAYMRKRWGITKIREDGDCHHAVDAVVIACTTDAMIRQVSRYARFRECEYMQTESGSVAVDTGTGEVLRTFPYPWPDFRKELEARLANDPAKVINDLHLPFYMSAGRPLPEPVFVSRMPRRKVTGAAHKDTIKSARELDNGYLIVKRPLTNLKLKNGEIENYYNPQSDKCLYDALKNALIEHGGDAKKAFADEFRKPKSDGTPGPIVNKVKLLESATMCVPVHGGKGAAYNDSMVRVDVFLSGGKYYLVPIYVADTLKPELPNKAVTRGKKYSEWLEMADENFIFSLYPNDLICATSKNGITLSVCRKDSTLPPTVENKSFMLYYRGTDISTGSISCITHDNAYKLRGLGVKTLEKLEKYTVDVLGEYHKVGKEVRQPFNIKRRKACPSEML* |
| MG3 effector | 11757 | MG3-18 effector | protein | unknown | MSTDMKNYRIGVDVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLR |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | RTFYEQGLDKLDRDQLHPGEDWRNFTGLYPASQKKFLEWKDAATAL<br>GNVLAEAIEDDSIAVVSPLRLRPQNGSVHDETIDPVKKQTLGSDWPADA<br>VKRIVDPEIYLAMKDALGKLKELPEDSARSLELPDGRFVEADDEVLFFP<br>ENAASILTPRGVAEIGGSIHHARLYGWLTKKGELKVGMLRVYGAEFP<br>WLMRESGSRNVLSMPIHRGSQSFRDMQDTTRKAVESGEAVEFAWITQ<br>NDELEFDPDDYIAHGGKDELRQFLGFMPECRWRVDGFKKNYQIRIRPA<br>MLSREQLPSDIQRRLESKTLTKNESLLLKALDTGLVVAIGGLLPLETLK<br>VIRRNNLGFPRWRGNGNLPTSFEVRSSALRALGVEG |
| MG3 effector | 11758 | MG3-89 effector | protein | unknown | MSAPLNYRLGFDVGERSVGFAAVEYDDQGYPLKFLAIGSYLHDGGMD<br>PTTNKNPKSRKETRGVARRTMRMRRQKIKRLKKTDKVLRELGYQVS<br>HYTDEPQTYEAWYSRRLLATQKLSSEELNDHMVRAVRHMARHRGWR<br>NPWWSLTQLESASAEPSETFVQMFEKAQERWADELILPIEETTLGMLG<br>ALSDDNKVLLRPRTYDSKKEKHKEKLNVKGEEPVFFAKVRQEDILREL<br>RIICVRQGVESQYEELRKALFDQIRPHVPQENVGRDPLDPSQYRALRAS<br>LEFQRYRILDALANLGVREGRGKPRSLTGEERTQAWKFLSTYRDQKN<br>APTWGDVAEAMGVEPALLVAPVIDEVRLNKAPYFSSLVAVEKKLKKK<br>HQIYKWWVEASVESRGLLIRVLADATNATLDEASEAGLLELIEGLPEE<br>EREVLDGLSFETGRAAYSADTLTKLADYMEEHLAEGIGVHEARKAVF<br>GVDDSWQPPKATLEEATGQPTVDRVLTIVRRVVLSAQRQWGDPAEIM<br>VEYARTGLMGPAQLAEVKREIAKNRKERDRIRQDLKDGGVSEPKKRH<br>IMAHRIVQDQNCQCMYCGAMITAASCELDHIVPRAAGGSSRRENLAG<br>VCRDCNASKGGRMFADWAADNPRGVSLKDTLGRLRSWEPFKKADKK<br>RLLKLIERRLKQSVMSPEQIDERSLAPTAYAATAIRERLRRHFEDDAKP<br>IPRKDVVKAYAGGLTRESRRAGLIDEKLLLRGSRDKSRLDVRHHAIDA<br>AVLTMLNVPVARTLEERRLMKRERDLSARDNDWRDYTGTAEDKPKF<br>VQWKQAAGEMADLLIDAVDQDSIAVINPLRLRPQNGAVHDDTIRPLEE<br>RALGAEWDPATIKRVVDPSIYLALVDALGKSKSLPADSQRELVLDDGT<br>LMSADDSIALFSTNAASILTPRGAAEIGGSVHHVRLYAWRDRKGEIEVG<br>MQRVFGAEFPWLMRESGVKDVFKVPVHRGSQSYRDLQDGVRKQIESG<br>AAVEIGWITQGDEIQLNLDEVRDSMRSKELLTFLEIFPETRWRVDGLPD<br>NRRLRMRPVLLASEGIEEFLKNAPEDIQTIVVNFFKNGALLSVSKVLAL<br>TETKIIRYNHLGFPRWRGVGRPVSLDIQRAAREALEGKK |
| MG3 effector | 11759 | MG3-90 effector | protein | unknown | MSQEATKYRIGIDVGDRSVGLAAFEFDDAGFPLRKLAMVTYRHDGGL<br>DPTQNKSPKSRKETAGVARRVRRLRKRRKERLKKLDLKLLELGYPLP<br>EGEEAQTYQAWKSRALLTSQKIEDKAEQAEHLVRALRHMARHRGWR<br>NPWWQFGQLDSAPVPSETMVENLNHARLLWPGYITDQTTVGELGALA<br>ASPDILLRPRTRDIKKKPNGLHHQEGVRAVLGSKVRQEDLLAEVKKIW<br>QVQELPVSHYEELARALFEQVRPYVPAQNVGRDPLPGRHHLPRAPRAS<br>LEFTEFRIRQAVANLRVREGREKVPLTSGQHIAAVNYLMNYADKQPPT<br>WGDVAEQIGVEPTRLVAPVIDDVRLNKAPYNHSTSVFTRALPKKSEAM<br>QWWNSADVSLRSLLIIFLSDPTEEATAAADESGLSAIFESWPEKEREKL<br>EGLDFESGRAAYSIQSLIDLNQYMEEHQSDLHTARKEVFGVDDSWQPP<br>RENLHEPTGQPAVDRVLTIVRRFVMACERKWGKPDRIVIEHARTALM<br>GPTQRHEVLREIQRNRDANERIREELRADGLTSPTRADVRRHRVVQNQ<br>DCKCLYCGTMITTATAELDHIVPRAGGGSSKIDNLVAVCRGCNADKGR<br>IPFAVWAEQTSREGVSLDDALNRLWSFDKVVYKGVAGRKLKAQIARR |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | LRQAEEDEPIDERSLESTAYSAVAIRHRLETYFNTSRGLNRGDDGFTFIDVYAGALTREARRAGGIDEQILLRGQRDKNRFDVRHHAVDAAVMTVLDHSVARTLAQRNLIYREDRLKRRENQDDTRWREFTGLGGEAQEKFLVWKQKSYVLADLLAEAIAEDSIPVINPLRLTPRNGSVHKDTLSSLDKMYLGGSWSSKDIARVVDPDIYLALMELLGRATTLDEDPQRSLTVKGKVLQADQEIKLFPESAASILAGTGAVKIGDSLHHARLYAWPTKKGHEIGMLRVFGAEFPWLFKTYGTKNALTVPIHPGSQSYRDMKDTLRKKIESGEAREIGWITQGDEIEIKIESYLQENDELGRFINLIPENRWKIDGENDNGRLRLRPILLSYEEIPESYGEDVLGAKNHQLIRKVLERGAIITAGKILGAEGTKVLRRNHLGAPVWQGQQEARSLDISRAITEKLEG |
| MG3 effector | 11760 | MG3-91 effector | protein | unknown | MSMISTNDDRVEGMHMARYGERKYRVGIDVGDRSVGLAFIEFDEQDMPSELLRMFTVRHDGGIDPTTNKTPKSRKETAGVARRVRKMRKRRTKRLQELDALLMASGFPIVDVSVGETYECWQARAAAVEGFITDEQTRLETVSRAIRHMARHRGWRNPWLTWQGFRELEVPTANHRKNIESANSKLHLDLEDTSTLGQIAASASASNWMLRPRNGQKRKEASNPVLVAQVQQADQLAELYKILEVQRIDSTITEKIARAVFDQVRPYVPKGNIGLDELPGMGAYYRASKASLAFQEFRVRAAVANLRVKNSPRGQERLRLDPQDAQAVAEYLLTWREDQPPQWGDVANALSIDENLLVIPVFEDAFLKLAPYDRTSSDLEQRLSSSANKKKLAGVREWWDSADTQMRELFIEFITSPNESVYEEADESGFSDVFNGWSDEAKEVLLGMQFESGRSAYSVESLRRLNLRLRTGEVDLHEARRLEFGVDDTWRPSLPSIDERTGQPAVDRVLTIVRRAIMGAVDKWGVPEAVVVEHARSGFMGASARNDYLNEVSRRTATRAKLREIVKQQGVERPSDGDIHKWECINRQRCTCAYCGNEITFTTAEMDHIVPRAGGGSNVRENLVAVCRRCNSEKRNIPFAIFAESDAHPYTSLNETLTRVRNWDWSRDRSEQRLKNRMLQRLKRRESDPEIDERSLASTAYAAVEVRQRIAEYLGRITGEDELNRVQVYTGGATREARRAGKIDARIRIRGKDEKDRFDVRHHAIDAAVMATLNHSVAFTLRERAEMKRSATMNRYLDPNEEWKDYSGRTSSAQKRFTVWRQQAHRLADLIVDAVEADSVPVAQQLRLSASRGSVHKDTVSALVRKQLGAPWTAQEILQIVDPEIYVHLRDLAAQNKGVLELDPSRRIQLLSGVWISGSELVEVFPKAAASMKVSSGSVEIGEQIHHARVYAWRGTKGEFQYGILRVFTAELPWLQRQAQSKDLFTMNIDDRSMSYRDLLQTVRKKIESDEARCIGWLTQNDELVLNVEVLRQGSDKIAHFLSTYPESRWKLDGFPENRRFRIRPLYLSREGSDHLDPICAEILEKGAIVGTSNLLSNVHQIIRRDSLGFERWRSQGGLPASWSVPDSTADTVETGLK |
| MG3 effector | 11761 | MG3-92 effector | protein | unknown | MAQRRYRVGIDVGDRSVGAALVAFDDDGIPERVLHAVSYRHDGGIDPTTNKTPQSRKHTAGVARRVRRMRARRTKRLAALDRALIELGLPVRDVSDGETYEPWRMRARCVEGFIEDDAERRDAVSRALRHIARHRGWRNPWHSVRRERLESVPTATHQKNVAAAQAVFPGEIAADATVGQLGEVASRFNHMIRPRTGKKNPKQKTAVLNERVMQADQMAEVVAIWTTQRMPEAELNAVLELVFGQERPVVKAENIGRDELPGMGHLPRAPKASFEFQEFRIRATAATIGVRARQGSSKAERLDADAVDAVSHWLLEWDADDDPTWADVAVEALNLDPRFIKAPVFDDVRRMTAPVNRTARILRKALKKRHNAPVRTWWESASAESRAALVAFLVDPTDENEDLLDRTGLSDVVAAWPEEVLDDLTNLNYEVGRAAYSRESLSKMNTIMAEQRVGLHDARKIAFGVDDTWAPALPQLSEPTGQPTVDRVLPIVRRIVMAAYERYGVPEAVYIEHARSALLGPAARAEHQREVNANRREREKNRQILIEQGIDDPNRSDIRRWHQVQLQ |

TABLE 24-continued

| Category | SEQ ID: | Description | Type | Organism | Sequence |
|---|---|---|---|---|---|
| | | | | | NCLCLYCGQTISAAAGGAELDHVVPRAGGGSNRRENLVAVCRQCNSE KGKLPFAVFAARTQREGVSVEAALERVRGFQWRPADRAVKRGLVHR LKQTAADDPIDERSLESTAYSAVEVRRRLERFYSDHASPEAPRPEIFVFG GSITSEARKAGGIDAIIRLRGKDVKDRFDARHHAVDAAVMTLVDRSVA RTLQQRSDMRYAHRLTGSEPAWREHAGDSAAAQSRFAEWKKKSYRL AELLREAISADAIPVIFPLRLGVNRGSVHKDTVRAAVPKRLGDAWSAAE LDAVVSPAAHMALSSVFDGAAELPHDDGRMLTVRKRRLHADDTISLLP GHAAAIEVNGGVVEIGESIHHARLVAWRDRKGVIQFGMVRVFTAEIPF MQRLAGKKDVFSIPVHPSTLSYRGVQLRVRKALDAGIAVELGWITQGD EIEIGLDDVASMTPEFRQFIAEIPEQRWRVDGFKDGGRLRVRPALLSAE GDAAVSDLVSKTLDKGSFVNAAGFIGAPSSVVIRRSALGVPRWRSAQG HLPVSFSPYQRAENLL* |
| MG3 effector | 11762 | MG3-93 effector | protein | unknown | MNEGVIQYRIGIDVGQNGVGLAAIAFEAGNPSEVLAMVTHRHDAGLDP AAAKQGYSRKKTSGVARRTRRLRRNRARRLKKLDEILTSLGLEVPAH EVPQTWEAWEARAELQEFPIDNEQELHEKLVLAVRHMARHRGWKNP WWSWNTLWEAPTPTSNMNEIRDNARKVFADLPPTATIGQIGFVAAAT NRLLRPRKDTTKAKTKRPTPVLNAKVMQEDQLAELRSYWDKQNLPD EWLEKIAKAVFYQTRPKVKPELVGHDDLPGMTKLPRASRSSLEFQEFR IRAAIANLKVKVPGSRQENFLSVGDKNRIVDLLMGWDDDEAPTWADV AEELNISVRDLKRPEFDDSPLRVAPYDRSSNAIRNKLVSLRKDGKEALE WWDTADRDQRSLFATWLGDQSQHDDAFLETSGLSDIIASWSEGVMEK IDSLSLEPGRAAYSIESLKILNRHLAEGDNLHEARKHGFNVDDSWTPSL PRFEDRTGQPVVDRVIRIVHRFINGCVYKWGVPESIVIEHVRSGLLGPE ALLDYKRETTRHRNEREQIARDLKDQGISERPSSGDITRMRIVQEQQG VCLYCGTAINIHCELDHIVPRAGGGSNFRENLAAVCRECNRLKGKTPF ARWARETSQEGVSLEGALDRVKNFSVNGSTADLRNLKRRVSQRLRQT DEDQPIDERSMASTAYAALEVRDRVREFTSRFTDTDIPVEVYRGSITSAA RKAGHIDKLILLRDKDIKDRGDFRHHAIDAAVMTVINRSNSQVFAIREA MRSAHAMTGSEPNWKDFRGNSPRQEEKFIEFETRAAHLARIIRERIDA DRIPVISPLRLKPETGKVHADTIVPFDYKALESEWTDKDIVRVVDNELY LALVDALGGKKVLPTDKISVIDQDLAKDHRQVALYGTPSPQIPVRGGS AAISDSLHHFRVYAWKDKKGAIQFGQQRVFGAEFRAMWGDPRQVDV FTAPVPRWAFAHREMPPKVKAAIEAGNAKQIGWYTRNDEIELDLSEL MAQSNVLGEFLRELPEKSWRIRGSHSLSRLSLSPLYLSSEGTDLSEQSRP VQDAVSKGIPVSASSILDSESMIIRRGPLGIPKWNGGNATSYSFRQVAEE VLGTD |
| MG3 effector | 11763 | MG3-95 effector | protein | unknown | MTNHSPAGSISSTDWVLGVDLGQRSVGLAAVALDPDGTPTEILASNVV RIDGGLLPGSEESPVSRKAAAGMARRVRRLHRRRRARLKALDRRLMD LGFPVDDGPETYESWLDRARLVEGRIANETERKRATSRAVRHIARHRG WRNPWLSWSAFAELSTPSDNHRRNLAAAAERFDRETEGWTVGQLGA AGTDPRITIRPRTAKDSRRIVHGEAALLEHRVLQEDQLAELRQIWTTQ EWDPAELPELEKAVFTQAEPFVPPGNVGRDALPGMQTHPRAPRASLEF QRFRIQSVVGNLRVPVTERSGDLRPLTPEERERVTGLLERWHEREGHV PGERPTWRDVAEAVGVSLRNLRGRDTSDYATATPPTMETLDRLKAGI AALKPAAVRRDVAAWFDEAEDDQISAFVSYLADSTDASNEALDEAGLT DIITGWDEAALEKLGDLPLEPGRAAYSLESLNRLTGRMQADAVDLQEA |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | RKREFGVDDSWTPPTPSIETPTGMPAVDRNLVAVRRFVMSMVSQFGM PQLVVIEHVRESFLGVTAVEELRRQQRLDRRRRETAAKEVAAASGKEP RAADVRRYSLIQRQNGQCAYCGTAIGLRNSELDHIVPRAVGGASTRAN LLAVCRACNNLKGKQPFAVWAAADTRTDEDGEKLVSVEAALARTRS WMAPRPSIRERNELREIRQRLRQRESDEPIDERSMESTAYAATALVERV QNYLESQTPEGVQTPPVRVYRGSITASARKSSGVDKVIRLRGKSMKHR GDFRHHAIDAAVCALITPSVARTLAIRESLRTAHRFTGDEHDWKSFTG DSPQARAEHTAWTARMQTLAKLLRDAVDADQVPVSIPLRLGRRVGRV HEDKVRPFDSRPLGGTWSAKELERIVDRRLYTALHHVAASATSGVEVT PELCTELGSSMGATVKLYGSPAAQIPVRGGSARLGAIHHARLYAWRGT RGIEFGMMRVFAGELTAMWPSPATDVLTAPVPEWSMSYRRTAPAVM QQLRSDTAVQVGWIAPGDEIVVLPPREGARASSLDSLVSSVGEDRWTV TGFERATTINVAPRLLSAEGISEETPKAVTSVLNRPGRLAASSLLPRIRVI RRDALGRERRRGGGRLPSSFVPFEVAEQRLQGD |
| MG3 effector | 11764 | MG3-96 effector | protein | unknown | MSTDMKNYRIGVDVGDRSVGLAAIEFDDAGFPIQKLALVTFRHDGGLD PTDNPKSRKETRGEARRRMRMTRRRKQRLCDLDKVLENLGYTVPEGP EPETYEAWTSRALLASIKLASADELNEHLVRAVRHMARHRGWANPW WSLDQLERASQEPSETFEIILARARELFGEKVPANPTLGMLGALAANN EVLLRPRAEKKKKTGYVRGTPLLAAQVRQIDQVAELRRICEVQDIEEQ YETLRNAIFAHKVAYVPTERVGKDPLAPSKNRTIRASLEFQEFRILDSV ANLRVRTDSRAKRELTEGEYDAAVEFLMGYTAKEQPSWADVAEEIGV PGNRLIAPVLEDVQQKTAPFDRSSAAFEKAMSKKTEARQWWESNDDD QLRSLFIMFLADATNDTEEAAAVAGLPELYMSWPAEEREALSNIDFEK GRVAYSHETLSKLSEYMHEYRVGLHEARKAVFGVDDTWRPPLAKLEE PTSQPTVDRVLTILRRFVLDCERQWGRPQAITVEHARIGLMGPVQRQK ILNEQKKNRGENERIRNELRESGVENPNRAEVRRHLIVQEQECQCLYC GTMITTTTSELDHIVPRAGGGSSRRENLAAVCRYCNGKKNRKLFYEW AGPVKMQETIDRVRQLRAFKDSKKAKMFKNQIRRLKQTEADEPIDERS LASTSYAAVAVRERLEQHFNEGLTLDDKSRVVLDVYAGAVTRESRRAG GIDERILLRGERDKNRFDVRHHAVDAAVMTLLNRSVALTLEQRSQLRR AFYEQGLDKLDRDQLKPEEDWRDFIGLYPASKEKFLEWKKTATVLGD VLAEAIEEDSIAVVSPLRLRPQNGSVHKETIAAVKKQTLGSSWSADAVK RIVDPEIYLAMKDALGKLKELPEDSARSLELSDGRYIEADDEVLFFPEN AASILTPRGVAEIGGSIHHARLYSWLTKKGDLKVNVLRVYGAEFPWL MRESGSSDVLRMPIHPGSQSFRDVQEETIEMIEGGFAKEIAWITQNDEL EFDPVEYINLPGRSDKLTRFLIYMPETRWRVDGFPESRNLRIRPLMLSQ EDLPSEIKKHKEEKQLSDEEKLLVEALEKGLIITSSKLLGLKSIKVIRRN NLGFPRWRGNGNLPTSFEVRSSALRALGVEG |
| MG3 effector | 11765 | MG3-103 effector | protein | unknown | MSADSLNYRIGVDVGDRSVGLAAIEFDDDGFPIKKLAMVTFRHDGGM DPATGKTPKSRKETAGVARRTMRMRRRKKKRLKDLDKKLRDLGYFV PRDEEPQTYEAWSSRARLAESRFEDPHERGEHLVRAVRHMARHRGW RNPWWSFSQLEEASQEPSETFGRILERAQHEWGERVSDNATLGMLGA LAANNNILLRPRRYEHNPKTGKNAEKLNVRGQEPILLDKVRQEDVLAE LRRICKVQGIEDQYPELAHAVFTQVRPYVPTERVGKDPLQPMKIRASR ASLEFQEFRIRDAVANLRIRVGGSERRPLTEEEYDRAVDYLMEYSDTTP PTWGEVADELEIAENTLIAPVIDDVRLNVAPYDRSSAIVEAKLKRKTQA |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | RQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHENDDLPDGFAPVSVDVYGGSLTRESRRAGGIDKSIMLRGQRDKNRFDVRHHAIDAAVMTLLNPSVAVTLEQRRMLKQENDYSSPRGQHDNGWRDFIGRGEASQSKFLHWKKTAVVLADLISEAVEQDTIPVVNPLRLRPQNGSVHKDTVEAVLERTVGDSWTDKQVSRIVDPNTYIAFLSLLGKKKELEADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLTVLPENRWKVVGIGDNRRFKIRPLLLSNEIIPDTLNGRSIKSEERDLIVSVLDKGVRVVASTLLTLPSTKIIRRNNLGIPRWRGNSHLPTSLDIQRAATQALEGRD |
| MG15 effector | 11766 | MG15-166 effector | protein | unknown | MKYIIGLDMGITSVGFASMMLDDNDEPCRIIHMGSRIFEAAENPKDGSSLAAPRRENRSMRRRLRRKRHRKERIKNLIIQNNMMTADEIDAIYNSGKELPDIYKVRAEALDRKLDTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMVGSCTLEPDEKRAAKATFSFEYFNLLTKVNSIKVVSSAGKRSLNEDERKRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNKIIPYLEQGMLYHDACTAAGYNFKADDTDKRMYLPAHEKEAPELGDITNPVVRRAISQTIKVVNAIIREMGESPCFVNIELARELSKNKAERSKIEKGQKENQARNDRIMERLRNEFGLLSPTGQDLIKLKLWEEQDGICPYSLKPIKIENLFDVGYTDIDHIIPYSLSFDDTYNNKVLVMSSENRQKGNRIPMQYLDGKRRDDFWLWVGSSNLSRRKKQNLLKETLSDDDLSGFKKRNLQDTQYLSRFMLNYLKKYLTVAPNATGRKNTIQAVNGAVTSYMRKRWGIQKVREDGDTHHAVDAVIISCVTAGMTKRISEYAKYKETEYQNPETGEYFDVNKNTGEVINRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVESLYQNDLIGIKLKKEMKFSLVQKNSTLPKNINVKDGLFYYKGTNISGANISVINNDNTYTVESLGVKRIPVIEKYQVDVLGNVSKVGKEKRVRFQ* |
| MG15 effector | 11767 | MG15-191 effector | protein | unknown | MKYIIGLDMGISSVGFATMMLNEKDEPCRIMHMGSRIFEAAEHPKDGSSLAAPRRENRSMRRRLRRKCHRKERIKNLIVSNNILTADEIDTIYNSGKDLTDIYQIRAESLDRKLNTEEFVRLLIHLSQRRGFKSNRKVDAKEKGSEAGKLLSAVNSNKELMTEKNYRTIGEMLYKDDKFAVFKRNKADDYTNTFAREEYEEEIQKIFSAQQEYGNQYATDELKEGYLEIYLSQRSFDEGPGGNSKYAGDQIEKMVGFCTLEPDEKRAAKATYSFEYFNLLTKVNSFKILSAEGKRSLNENERQKIIKLAFNKNAISYASLRKELSVGYSERFNISYSQSD |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | KSIDEIEKKTKFTYLTAYHTFKKAYGSALIEWSTEKKNHLAYALTAYK NDNKIKNCLTEHGFNETECEIALTLPSFSKWGNLSEKALNKIIPYLEQG MLYHDACTAAGYNYKADDTDKRMYLPAHEKEAPELENISNPVVRRAV SQTIKVINAIIREIGESPCFVNIELARELSKNKTERNKIEKGQKDNQARN DRIMERLRNEFGLISPTGQDLIKLKLWEEQDGICPYSLQAISIERLFEAG YTDIDHIIPYSISFDDTYNNKVLVMSSENRQKGNRIPMQYLQGKRRDEF WLWVDSSNLSRRKKQNLLKETLSDDDLSGFKKRNLQDTQYLSRFMLN YLKKYLKLAPNATGRKNTIQAVNGAVTSYMRKRWGIQKVRENGDTH HAVDAAVISCVTAGMTKRISEYAKYKETEYQYPENGEYFDVDKRTGE VINRFPMPYPWFRNELLMRCSENPSRILQEMPLPNYAADEAVDPIFVSR MPKHKAKGSAHKETIRKAFEEDGKKYTVSKVPLEDLKLKNGEIENYF NPKSDTLLYNALKSRLIEFCGDAKKAFEAPFYKPKSDGSKGPLVKKVKI VNKATLTVPVLKNTAVADNGSMVRVDVFFVEGEGYYLVPIYVADTVK KELPQKAIIANKTYENWKEMKEENFVFSLYPNDLIRIKSKKEMKFNLV NKESTLAPHYQSKDAYVYYKGSDISTAAITAITHDNTYKLRGLGVKTLL AIEKYQVDVLGNIIKIGREKRMRFR* |
| MG15 effector | 11768 | MG15-193 effector | protein | unknown | MNYRLGLDIGITSVGWAVLEHDSSEEPFRIADLGVRIFDRAEHPKDGSA LALPRREARSSRRRIRRHRHRLERIKALLESQGIITIEKLQEVYHGSKEL TDIYELRCLGLDNLLTQEEWARVLIHLAQRRGFKSNRKKEIKENKKEK NEDGKLLAAVRDNQALMQEKNYRTIGEMFYRDDKFSLNKRNKSELYS HTVGREQILDEIAQLFTAQRRLGNSYAGEKVEQLYTDIVSRQRSFDEGP GTPSPYAGNLIERMRGKCTFEKEEPRAAKACYSFELFNLLQKINSLRID DKNSASRPLNKEERQLLIQSAHEKADIKYTDLRKKLQLSPEQRENTLSY GRDDVEEIEKKNKFNYLKAYHDIRIALDKVSKGRIKQLPVEHIDMIGEI LTLYKNEDRITSKLRKTGLTEYDIEELLSLSYSGFGRLSLKAIKNILPYL QEGHIYSEASTLAGYNFRGHDNVVKQMYLPANNEQLQDITNPVVRRA VSQTIKVINAVIRKYGSPQLICIELSREMGKNFFDRKRIEKQIKENTDLN DAVRNKIIEYGHLNPTGLDIVKMKLWQEQDGRCAYSGEPISIQDLFDA GIADVDHIIPYSVSFDDSYANKVLVKSSENRQKGNLLPLEYMKNNPNKQ EKFIVWVNTNVRNFRKQQRLLKKTITEEDRNKWKERQLNDTKYISRF MLNYIRDYLEFAPAENIGKRKVISVNGNITAYMRKRWGLKKDRLAGD LHHAQDAVVVACVTEGMIQKITRYSQYCEAKNNRSHFVDYETGEVIDT LRNRFGADFVEPWDNFKIEMVSRLSDDPALRIDAYKLDNYLDLKDIKPI FISRMPNRKNKGAAHQETIRSSRLTGEGLVVSKINITKLKLDADGEIAN YYNPKSDMRLYNALKNRLQQFNGNGEAAFKEPVYKPAAPGKTISPVK KVKVIDKSNLNVAVGKGVAANGDMLRIDVFKKGDGYYWVPIYVADTV KETLPNKACVHSKPYELWKEMDDNDFIFSLYPNDLIRFIPNNGEEAFM YYIKAGISTASITVESHDRSQSIPSLGVKTLKILEKWNVDVLGNRTLVKN EKRQYYPGQTTR* |
| MG15 effector | 11769 | MG15-195 effector | protein | unknown | MKYGIGLDIGIASVGSAIVLLDGSDEPYKIYRLSSRVFPKAETDKGESLA SDRRNNRGMRRRLRRRRHRKERIRNLIYDVFDVNEDYITEIYAESGLK DIYQIRYEALDRKLDKDEFIRLLIHLSQRRGFKSNRKSDVGKKDDGKLL DAVKKNTELRQKMYRTIGEMLYCDDRFADSKRNTEGNYKNTFSRSEY GEEIKCIFENQRAFGNEYATEDFEEKFIGIIMSQRSFDEGPGPGKDSKYS GNLIERLVGKCTFEREEMRAPKASYTFEYFNLLSKINAIKIVSANNTRC LTEEQRAIIKNLAFSKNDLSYKSLRKALGLNEDELFNISYTDSDTNKKK |

TABLE 24-continued

| Listing of additional protein and nucleic acid sequences referred to herein not included in the sequence listing | | | | | |
|---|---|---|---|---|---|
| Category | SEQ ID: | Description | Type | Organism | Sequence |
| | | | | | AKNKKGTADKFSERDAVEDKTKFSYLKAYHTFKKAYGDEYDRWSTD<br>KKNYLGYVLTVFKTDKNVELKLRERNFSDDEINIAQTIPSFSKLGNLSV<br>KAMNKMIPFLENGEIYNKAAEMAGYNFKADDKCAGMYLPANESKAPE<br>LGDIANPVVRRSVSQTIKVINAIVREMGESPVYVNIELARDLAKSHDER<br>EKIEKNNNANRQKNDKLMEELRKEFKLANPKGEDLIKLKLWNEQNGR<br>CMYSYEPIVRERLFEPGYAEIDHIIPYSISFDDTMSNKVLVKAKENRDK<br>GDRLPLQYMTGKKADDFRVRVSNSILSRKKKNNLLKEQLTEEDRKSF<br>KQRNLQDTQYISRFMMNFIKKYLKFAGEAKIVAVNGRATDYMRKRW<br>GIRKIRADGDTHHAVDACVVACATHGMVQRISEYSKYKETEYIDDDGR<br>IYDINKKTGELTDRFPMPYPMFRKELEMLTSNDPQRILSQSKFPNYSGD<br>EQLEPIFVSRMPQHKVTGAAHEDTLRKPVTENGQNYVVQKVKLTKLK<br>LNDNGEIENYYMPQSDKLLYNALKERLAEYGGDGEKAFKNLTEPFRK<br>PKSDGTPGPIVTKVKTIEKQTCGVPLADNTTIADNGPMVRVDVFYVAG<br>EGYYLVPIYVSDTVKKELPNRACVANKPYSEWKVMDDKNFLFSLYNN<br>DLVKITFKREKKFSLVNKDSTLDKEHRTKSELLYYKGTNIHTASITVIT<br>HDNTYIFEGMGVKTLISIEKYEVDVLGRVRKVNKEKRMGF* |
| MG15 effector | 11770 | MG15-217 effector | protein | unknown | MRYVLGLDIGIASVGWAVLELDSFDEPFKIIDLNSRIFTKAENPQDGSSL<br>AKPRREARGNRRRLRRRRHRLDRIKHLIYVVGLMSKEGYDKLYTSGF<br>DKDVYTLRAEGLDRSLSAAEWTRVLIHIAKHRGFKSNRKSTTVAGEDG<br>KVLQAVKENQEILSKYRTVGEMFHNDDKFKSRKRNTTDSYILCVSRH<br>MLKDEIKALFTAQRSFNNPFTDEKFEAKYIEIFESQRAFDEGPGSESPYG<br>GNQIEKMIGQCTFEDGEKRAPKASYSFMRFNLLQKVNHIRIKSSSATRA<br>LSEEERSIIIALAYKSPNFTYGSIRKAIKLPYDMTFSDVYYKYEKGLSEE<br>ELIDKNEKSNKIKSLEPYHTIRKALDKVYKNRIEELSEDNINDIAYAFSV<br>YKTNAKISQKLKECGIDNKDIEALINNLGTFAKFGHLSVKACKKINKYL<br>ETGMTYDKACEAAGYDFKGHCGEKTKFLSGAADEIKEIPNPVVKRALS<br>QTIKVINAVVRKYGSPVEVHVELAREMARSKKDRDKINSIMKDNQAAN<br>DRIRGILKNEFNINNPTGIDILKYRLYQEQQGICVYSQKVMDLERVMK<br>DGKYAEIDHILPYSRSFDDSYNNKVLVKTEENRLKRNRTPYEYMQDNE<br>VKYKGFCEIVKSIIHNPTKVSNLLRENYNPQLVKDWKARNINDTRYISK<br>FVYNFLNDHLLLADGMRKRRIIAVNGAVTGYIRKRLGINKIRANGDTH<br>HAVDAVVIACVTQGVISKVTKYSQWQEVFYKNNNTGKLVDYETGEIIT<br>KDNFDEFIDSKFPEPWPLFRKELEARAGTNPKYEIECLRLDTYSPEEVT<br>SLRPMFVSRMPNRKVTGQAHQETIRSSRMANDGMTVSKVPLTSLKLS<br>KDGQSIEGYFSPESDRLLYEALLNRLQGFGGKADKAFTEPFYKPKNDG<br>SKGPIVKAVKITAPSTLNVRINNGKGLADNGSMVRIDVFHITAGKGAGY<br>YLVPIYVADTKKDKLPSKAIVAHKKYDEWKLMDEKDFVFSLYPNDLIY<br>VEKKGNIELSLDKKIEKDSTLPKKISSPQGYFYYVKAGIGDGSVQIKSH<br>DGVYLLPSMGVKTLKLLRKCVVDELGNISFVGKEKRQHF |
| MG15 effector | 11771 | MG15-218 effector | protein | unknown | MNKSVKFGLGLDVGIASIGWATVALDEKGEPYKLLNLGSRIFDKAENP<br>KDGSSLAMQRRQFRSQRRLIRRRRHRLDRVIFLFQKIGLCTNDELNKL<br>FQTPAPKNVYELRVDALDRKLDKQEWIRVLYSVLKHRGFKSNRKNAK<br>SEDGLLLKAIQSNEEIIFNNGYRTVGEMLFKDPLFTNSKRNKGGSYKNC<br>VSRISIQKELDLLFEKQREYGNEFTSDYFKESFLNIFLAQRNFDEGPGAP<br>SCYGGNLIEKMIGYCALKKDKKRAPKASLSFALFSFWSKINNIRYYDSN<br>RCKEYSISTEQARKVLQKALIKSDLNYSDIRKIIGLDDGCYFKDITYTSK |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | KSKKTKKKQQAKNNNESYLSIDGLTLVEDVLTPEKDANEQSVDTILDIE KKSKIKFFNSFISIKKAANGMLDHLNPFDPEDRKIFNRISYAFTVSKNDD GIAGYLNEIDISAEIKESLINNLDGFSQFGHISEEACEKLLPFLENGCDYT SACVEAGYVSSSDDVVGKDLLPARSSELDDIVNPVVRRSVSQLIKVVNSI IRENGKPEYINVEFARDLARSFADRREITKEQEDRKAHNEKVRKIIEET FGRARASSKDILIYKLWMEQESKCIYSGKHIDAHRLFEPGYVEVDHILP FSKSFDDSMTNKVLVFKEENQNKANRTPLEYMRASKPMYVDSYLAMV KFLYKSNFKKLQNLTTEFCGNDREEWSTSNLNDTRYIAKFIHKYIKDH LYPAKTGIKRVRAVNGRITSLLRHFWGIKKIRENGDLHHAVDAAVISV TTDMIIKKFSEASKRHEEYDEKIMVEKPWEMFVDEISARISENPADQVE RLGLSTYSDEEKSSLKTPFVSRMPRHKVTGSVHDSTLRSPVLLKQGINA YVSKREINDKLLKVFDDKKCEFFNMQLDAKFYASLKSYLEDKNENKG EFHKIKKDGSLGPVVRKVKVVENCSSGVFLNNGKAFAKNGDMIRIDVF QVKEGKDKGFYFVPIYVADKVKDKLPSRAVIQGKDPKDWKEMKDEDF IYSLYPNDLIYFSSKKIVGFKNNNKSSEILGVDMSEGYLYYTGADISTASI NVDFVDNSFSKHGLGVKTLKEFRKFTIDVLGNIHEVKKEKRLVFGRK |
| MG15 effector | 11772 | MG15-219 effector | protein | unknown | MNYILGLDIGIASVGWAAVALDANDEPCKILDLNARIFEAAEQPKTGAS LAAPRREARGSRRRTRRRRHRMERLRHLFAREELISAENIAALFEAPA DVYRLRAEGLSRRLDEGEWARVLYHIAKRRGFKSNRKGAASDADEGK VLEAVKENEALLKNYKTVGEMMERDEKFQTAKRNKGGSYTFCVSRG MLAEEIGELFAAQREQGNPHASETFETAYSKIFADQRSFDDGPDANSRS PYAGNQIEKMIGTCSLETDPPEKRAAKASYSFMRFSLLQKINHLRLKD AKGEERPLTDEERAAVEALAWKSPSLTYGAIRKALPLPDELRFTDLYY RWDKKPEEIEKKKLPFAAPYHEIRKALDKREKGRIQSLTPDALDAVGY AFTVFKNDAKIEAALSAAGIDGEDAVALMAAGLTFRGFGHISVKACRK LIPHLEKGMTYDKACKEAGYDLQKTGGEKTKLLSGNLDEIREIPNPVV RRAIAQTVKVVNAVIRRYGSPVAVNVELAREMGRTFQERRDMMKSME DNNAENEKRKEELKGYGVVHPSGLDIVKLKLYKEQGGVCAYSLAAMP IEKVLKDHDYAEVDHILPYSRSFDDSYANKVLVLSKENRDKGNRTPME YMANMPGRRHDFITWVKSAVRNPRKRDNLLLEKFGEDKEAAWKERH LTDTKYIGSFIANLLRDHLEFAPWLNGKKKQHVLAVNGAVTDYTRKR LGIRKIREDGDLHHAVDAAVIATVTQGNIQKLTDYSKQIERAFVKNRD GRYVNPDTGEVLKKDEWIVQRSRHFPEPWPGFRHELEARVSDHPKEM IESLRLPTYTPEEIDGLKPPFVSRMPTRKVRGAAHLETVVSPRLKDEGM IVKKVSLDALKLTKDKDAIENYYAPESDHLLYEALLHRLQAFGGDGEK AFAESFHKPKADGTPGPVVKKVKIAEKSTLSVPVHHGRGLAANGGMV RVDVFFIPEGKDRGYYLVPVYTSDVVRGELPMRAVVQGKSYAEWKLM REEDFIFSLYPNDLVYIEHEKGVKVKIQKKLREISTLPREKTMTSGLFY YRTMGIAVASIHIYAPDGVYVQESLGVKTLKEFKKWTIDILGGEPHPV QKEKRQDFASVKRDPHAAKSTSSG |
| MG3 effectors | 11794 | MG3-42 effectors PI domain | protein | unknown | HGDVLTATIPASTFSFRNTPATLRKKLLAGEAVSVGWLTQNDEIEIEVD EFACGNTSFAKFLTEIPEKRWRVDGFYDNRRLRIRPAYLSAEGLTDNHS KVVHETLEKGQFVNAGALLSASRTLLIRRTALGAPRWKLDSSGLPVSF SPLKLAEEAL |

TABLE 24-continued

Listing of additional protein and nucleic acid sequences referred to herein not included in the sequence listing

| Category | SEQ ID: | Description | Type | Organism | Sequence |
|---|---|---|---|---|---|
| MG3 effectors sgRNA | 11795 | MG3-42 effector sgRNA | Nucleotide (RNA) | unknown | (N22)<br>GTTGGGAATCGTCACTGAAAAGTGACGATTCTCAACAAAAGACTTT<br>TGTCTTGATTTCTTTATCCCCCGGCATTTTGTGCCGGGGGATTCGTT<br>ATT |
| MG3 effectors tracr | 11796 | MG3-42 effector tracr | Nucleotide (RNA) | unknown | GCATCGTTTGAAGAAGTGACGATTCTCAACAAAAGACTTTTGTCTT<br>GATTTCTTTATCCCCCGGCATTTTGTGCCGGGGGATTCGTTATT |
| MG16 effectors | 11797 | MG16-3 effector | protein | unknown | MATKKILGLDLGTNSIGWALIETEDSNPKSILAMGSRIVPLSTDDSTQFA<br>KGQAITKNADRTQKRTARKGLNRYQMRRAMLTEELRRHGMLPERTD<br>ENIMDLWRLRSDAATDGKQLSLPQIGRVLYHINQKRGYKHSKADNSA<br>NTKQTKYVEAVNQRYRDIQACHQTIGQYFYEQLLSSAVQTPSGSYYTY<br>RIKDKVLPREAYIAEFDQIMKVQRVFYPDVLTDELVDTLRNHIIFYQRP<br>LKSCKHLVSLCEFEKRPFKREDGQIVYSGPKCAPRTSPLAQFCTVWEA<br>VNNITLTNRQNETFEITQEQRVAMADFLNQHDKMGVKDLQKILGISPK<br>DGWWAGKAIGKGLKGNTTFTQLREALGNLPNAEHLLKMKLSMVDAA<br>VDTTTGELIRQVSPQVEEEPLFRLWHLVYSLQNEDELRKALRKQFGID<br>DEEVLDKLCKIDFVKPGYANKSHKFIRKLLPYLMEGYQYHEACAHIGV<br>NHSDSLTAEQNAARPLLDKIPLLEKNELRQPVIEKILNQMINVVNALKA<br>EYGDIDDVRIELARELKSSKDEREAAFKRNNENERQNKIYENRIREYGI<br>QPSRSRIQKYKMWEESNHLCFYCGKPVNVTDFLAGAEVEIEHIIPQSVL<br>FDDSYSNKVCACRACNQAKGNLTAREFMEKHSKEEYDSYLRRVDDAF<br>NAHRISKTKRDHLLWRKEDIPQDFIDRQLLQSQYIAKKAAEILRQGYR<br>NVYATSGSVTDFLRHQWGYDEILHRLNLPRYQQVEGLTEDVTYDHCG<br>QEHQQERIKGWTKRLDHRHHAIDALTIALTQQSVIQRLNTLNNSREQ<br>MFDELGKRTDTPEYTEKRSLLEKWVDAQPHFSVQEVTDKVDGILVSFR<br>AGKRAATPAKRAVYQNGKRHIVQTGLQVPRGALSEETVYGKLGNKY<br>VVKYPLGHQSMKMDDIVDPTIREIVRTRLNAFGGKAKDAFAEPLYSDA<br>AHQMQIKTVRCYTGLQDKAVVPVRFNAQGEPVGFVKMGNNHHIAIYR<br>DAKGQYQESVVSFWQAVERKRYGIPVVIEQPHEVWDKLINSDNIPQDF<br>LETLPHDDWQFVVSLQQNEMFILGMDDADFEAAMEQKDYRTLNKYL<br>YRVQKISSKEYCFRYHTETSVDDKYDGVINKSISMELQKLKRLTSISAFF<br>SQHPHKVRVNLLGEVSAL |
| MG86 effectors | 11798 | MG86-1 effector | protein | unknown | MKKILSFDLGITSIGYSVLTEDEAQKYSLLDYGVSMFDKPTDKDGNSK<br>KLLHAQALSTKKLYKLRKERKKNLALLFEKYALAKASKLLEQEKKNL<br>YMYKWQLRAKKVFEERLSIGEIFTILYHIAKHRGYKSLDSGDLLEELC<br>VELGIKIDVKKEKKDDEKGKIKQALSTIESLRKEYPKKTVAQIIYEVEL<br>QKERPVFRNHDNYNYMIRREHINDEIATIIRKQKEFGNFENIDSEVFIVD<br>IIAAIDDQKESTNDMSLFGKCEYYPKEHVAHQYSLLSDIFKMYQAVANI<br>TFNKEKIKITKEQIRLLTEDFLNKIKKGKSVKELKYKDVRKILKLDESV<br>KIFNKEDSYQRAGKKVEHTITKFHFVDNLSKIDKSFIEDIFNADESYVL<br>MREIFDVIHKEKSPKRIYEQLKSKVSSEAVIIDLIRYKKGSSLNISSYAMA<br>KFLPYFEEGMTLDAIKEKLDLGRKEDYSVYKKGIKYLHISTYEKDDDL<br>EINNHPVKYVVSAVLRVVKHLHAKHGTFDEIKVESTRELSLNDKVKKE<br>IDKANKAREKEIEKIISNDEYQKIAKEYGKNIHKYARKILMWEAQERFD<br>VYSGKSIGIDDIFSNRVDVDHIVPQSLGGLYVQHNLVLVHRDENLQKSN<br>QLPMNYITDKEAYINRVEHLFSEHKINWKKRKNLLASNLDEIYKDTFES |

TABLE 24-continued

Listing of additional protein and nucleic acid sequences referred to herein not included in the sequence listing

| Category | SEQ ID: | Description | Type | Organism | Sequence |
|---|---|---|---|---|---|
| | | | | | KDLRATSYIEALTANILKRYYPFIDEKKSVDGSAVRHIQGRATANIRKV LGVKTKSRESNIHHGVDALLIGVTNPSWLQKLSNIFRENFGKIDDEARK NIKKALPYIDGVEVKDIVKEIEQKYNSYGEDSIFYKDIWGKAKTVNFW VSKKPMISKVHKDTIYADKGNGIFTVRESIIAKFINLKITPTTFPEDFMK KFHKEILEKMYLYKTNSNDVICKIVQQRAEEIKELLWSFEFLDVKNKE EMQEAKANLESLVHRELFDNNGNVVRKVKFYQTNLTGFKVRGGLAT KEKTFIGFRAFKKDKKLEYKRIDVSNFEKIKKSNDGSFKVYKNDIVFFV FDEEKYKGGKIVSFLEDKKMAAFSNPKYPANIQAQPESFLTIFKGKANS HKQVSVGKAKGIIKLKVDILGNIESYQVLGNAKSKLLDEIKSIVSH |
| MG86 effector sgRNA | 11799 | MG86-1 effector sgRNA | Nucleotide (RNA) | unknown | (N20)GUUUUAAUACCCGAAAGGGUAUUAAACUAAGGUCACUUUUUA GUGGCUGACUUUAGAGUAUGGCUUUGGCUAUACUCCAUUUU |
| MG94 effector | 11800 | MG94-1 effector | protein | unknown | MRKKIRYVIGLDIGIASVGWAALLLDENDNVCGIVRAGVHTFDEAVVG QSKITGAAYRRGYRSGRRSIRRKVNRIQRVKNLLQRLNIISKKDLEEYF SGAVENIYYLRCAAIQNEPAYILNNKELAQLLIYYAKHRGYKSNTSYEQ KTDDSKKVLSALSENKKYMLEKGYQTAGEMLYRDEKFRRKRYGSSEE CELLLVRNSGDDYSHSISRELLVEEVHVIFARQRELGNKLTTKELEDQF VEIMQSQRNYDEGSGEGSPYGGNLIEKMVGECTFEKGEKRACKASYTS ERFVLLEKLNHLRIQSKNGDVRALTEEERDAIIKLAYKNKDVKYKALR TILKLNPDERFGGLTYSRGDIENSTEGKSVFVSLEYWYEIKKVLGLFYD DLDNEETQQLLDSIGTILTCYKSDDLRRRKFEQLHLEQEKIEHLLALNY TKFQNLSFKAMKNIMPELEKGLSYTEACSNAGYGDKETIEGKNKYISK ELLNNTLDSIMNPTVKRAVRRTIRILNELIKQYGSPVEVHVEMARDLTH SQTVTNKMKKRQDENKAEKEEAKRFICENFGKTEAQVSGKDILRYRL WKSQNQIDIYSNTMIPVSDILDYEKYEVDHIIPYSCSENDSFNNKMLVRK KDNQDKKNRTPYEYIGSDEKKWEAFATCANTYVMNYGKRKNMLTKV PASNTGEWMSRNLNDTRYTTKVVTDLIRKHLKFEAYVDQKRKKHIYPI NGGITAKLRYEWGLEKDREKSDKHHAQDAVVIACCTDGMIQRLSRQY MLQEIGIVTWKNHKLVDRRTGEIVEETNLPWECFREEVEMFMADSPE DYIEKAKKNGYKGEAPKPIFVSRLPQKKTTGKINEDTLRSVRIDSKGKA RFVNKTKLQDLKLVEVDGKKQIKDYYRPEDDKLLYDKLLERLVKNDD AKVVFAEPFYKPKKDGSDGPIVRSVKTYGKTVKNQVLVGDGVAERGG IYRCDVFKRKDEYYAVVVYYRDLYIGNLPNNAAHFDIEMKKGEFEFSL YKDDLIRFVKDGKEQYAYYKYINANNSQITYTEHDTSKETKCTTIRTLD KFQKMNVDLLGNIYSSDKEEREWN* |
| MG94 effector | 11801 | MG94-1 effector PI domain | protein | unknown | KTVKNQVLVGDGVAERGGIYRCDVFKRKDEYYAVVVYYRDLYIGNLP NNAAHFDIEMKKGEFEFSLYKDDLIRFVKDGKEQYAYYKYINANNSQI TYTEHDTSKETKCTTIRTLDKFQKMNVDLLGNIYSSDKEEREWN* |

SEQUENCE LISTING (11831 sequences)

SEQ ID NO: 1 - protein, 1025 aa, unidentified
  REGION 1..1025: note = Description of Unknown:uncultivated organism with predicted taxonomy: CandidatusMelainabacteria
  REGION 1..1025: note = MG1-4 effector
  source 1..1025: note = Unknown organism with predicted taxonomy
MKKKVFAFDLGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESK

SEQ ID NO: 2 - protein, 1077 aa, unidentified
  REGION 1..1077: note = Description of Unknown:uncultivated organism with predicted taxonomy: Verrucomicrobia
  REGION 1..1077: note = MG1-5 effector
MHTKETVWGFDIGKGSLGEAVRVGNEFKHVLSMEIDADFAEIKTAAATRRAWRTREAHKAREMWLEKCLSDADIEILGRRKVDIVDGTWKLVSRGDGRLEREFPADGENVCYNSIALRCKLLLGEKLESWQVFKALNSAIQNRGYDAQIPWGDEDGKSSETKRSGKSDSAKKSGEDESYAERLALFEREFDKLLAEVENREKYDFPCFFKAAKMGLWSPENPDKVGIRIDNTAEKAKGYVVPRNAVIAEFRALVNAAAKQYPKLKGKADFIMFGKAEEAYASYKPELRRKFGLRRGADSDWTALGQKTPRFDNRIIGKCKLIPRLNVCKIKPLKECKAEDDFLPHTITLALKLLNLRFFRGAGIDSLSFDEFLRAFEIARQNKFALNKTNLKKFFKTIGAEIMDENQSSVEQPREGGRASYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDKTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLAEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLCKTKDDAERFKDLSKDGCGAYRKSKSHKGQFIWKDNKGNYLVAPVYIYSSKQKVYAELKNNPKCMGICDFFKTGCLVKISNEVVDEKKNRLWLKAGFYNLNSIAKEKRVYLTDVNGQEHKKIPLQHLMNAGMKRVETNTI

SEQ ID NO: 3 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-6 effector
MEKEKNNHVWGFDIGKGSLGEAVRVGGDFKHIASVLLDPEFGEIKTAALARRQMRTRKAHKAREKWLEECLDGTGVEILKRREVGIVDGQWRLISKGDERLEREFPPNGEEVCYNSIALRCKLLLGEKLEGWQVFKALNSAIQKRGYDENIPWGEAEEKSSKKDEDDYAQKLSQYEREKSELFESFADGEKYDFPCFFKAYKMGLWSPENPRRVEVRIDCRAQKAKSYVVARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIASGAKYKMTKTAMKKFLKSISATALGDDYAEIEPPKESGRASFSRPAMDILKELIFSGMPPREFYGRKIPEISNTDKNKGVVASDLDFIKLMGDCPWGGIFIPDVQTYQFANAAFPNPDAQINKLIGSQNNPIVRHRLTFFFERIKFLESKYGVPDKVVLEFVRDDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVLRVLVYYGEADEYKDLSKDGCGAYRKGDGHKGQVVWESVDGKYYVEPVYVHASKAGVMAALNANPKKKRICGMFNSHCTVDVGDVYNDRGDFILPAGRYMVNTILTTGRCVLTNADGEKRNPININYLMRAGMRRVELSEL

SEQ ID NO: 4 - protein, 1061 aa, unidentified
  REGION 1..1061: note = Description of Unknown:uncultivated organism with predicted taxonomy: unclassifiedVerrucomicrobia (miscellaneous)
  REGION 1..1061: note = MG1-7 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 5 - protein, 1294 aa, unidentified
  REGION 1..1294: note = Description of Unknown:uncultivated organism
  REGION 1..1294: note = MG1-1 effector
MWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENFFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTALAETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFERAALADTSFGLRVEGGKRIIVKRVSLFDLAQEPAGAPGKTKFSSKYLLKKIEWVRDATIRRRVKEEFLHKEPTEPNWQKFCDSFRQNSRNGVPGARIMKVWVYAGEPNEFKDLSKDGEGAMRKAKDDHQGQIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 6 - protein, 1031 aa, unidentified
  REGION 1..1031: note = Description of Unknown:uncultivated organism with predicted taxonomy: Verrucomicrobia
  REGION 1..1031: note = MG1-2 effector
MTWAFDLGLGSIGEAVQQKGEFKHAASWLVPSEFASTKAARTRRRMWRTRQAHKARESWLNQCLRSAGMEVLVGRRVERGPQGWTTLPGDPRLEREFPSAGDTTCYNSALLRIRLLRGETLAPWQVYKALHAAIQRRGYDPNIPWKSGASRSTEEKEEGETRARAAEYQSLLEDMAPGRTEFHYPCYLQAWKMRLWNPGQPEVLQERVSHDAESIHGMVAPRTLVEKEVRDLVAAAARYHPQLAGQADFILWGPACKPYASHNGTLRKQHGLRQGSEEDWEGVMGQKIPRFDNRIIEKCALIPRFNVCKMAPEGRAAAQPDAALPREVAFLMKLKNLRFSRGGGIAHLEAAEIATLFEKRREALSLTQKQWETACEKLGGRPLPPDLEVKAPRLGGRSAFCRPALKHVKELILSGKSPRDFHAEALARLHGNTNPQKGLVPADLDFLLRMGDSWEGLYLPNKRLEAISSRARTPDEAIREVIGSVNDPIVRHRLQLFVERLDELETRFGPPDQVALEFVREDFMGEKAKIEYRKFLNRREKERKEAREQAGQLGATSGSSGLKMELFKAQRGQCLYSGQRLHETKIEDYVIEHIVPRAKRGPDAVINYVLTTEELNNDKSDHIPFEWPYLKKQWDAYTQRVESCAGALGVKRVRLLVSPDAVELAQKYTALAETAWISKLAQTILNLKFGWTNGNTPDGRKAVVVVPGGLTARIRRKYSLNSLLAGDGVDEEEAEKKNRKDHRHHALDAMVISFLPGWVANPDKEHFFRFPEPVRANPRGFFQTAIHNVVPRQLCFEKGKLEETIYARRTIAGNSVAAVRQEFRALAFKSVGINKTEFNLDYLYKQTDKILEPRIRQLVQDFASTEPNEAAWERFCDEVRLPRKDGHPGPHVRRVRMRVGPMDEFKNLSKDRAASGAYRKGSTHHGQWVYRDATGRSLVRPVYAFESAGQVRRELIAMHGLDALVGYFQSGCLVELVRPVAHKKTPLAPGQFSLNTLRKDGFAVVTDARGRKSEPISLKTLLESGFHRVTS

SEQ ID NO: 7 - protein, 1200 aa, unidentified
  REGION 1..1200: note = Description of Unknown:uncultivated organism
  REGION 1..1200: note = MG1-3 effector
MNEYILREPDRKPLAEEWLNHEFYRSAVVLGIDIGLEGIGVYLRRGPQEIFARSIMLELPEAEALAERRQKRAWRHCRKNRKRRLHRLKQLFAKHGLPWLDADRMSRAHPFRERYRAINNGVASKEALSICIRHCVVHRGYDYGGTEEGTFPWGESPLLSKAAEWLATAYVTPELKEQIEQRAPGLVPGKNEEEQRNKFAELLRERLEWSQQHDIARVLAEHVKGGHDNLRTRARGYNFPRQKVWEHLETIVRKHAHLIDDVEGFLAVLGLNPNKAANAKEAAKARKRAIFFYNRKTRFDMERHWEKKVNRCPFAGKLGGNPDERCAENGDLNVRRWKALEFAATRRVEIEATEGKGATKKKRRCLHSLSASATRKLIEFIEKHHGAASPATAPKWEEGKAIILDDITAVHGEKAKPVAEKQSEWNKSYFTQLKDLLTPTLANRKKRASLSAFAAGHLFNIATADSSDFAPENVVTRLREAGFYDWRRNASVDFNPFPQVELLLGRRIKHGKRRGELSPTCQGLLRRIFAEHREALGGATAPDYCVIEVIGDPPRNARQRAERQKEIEANREKREKLFEQYGIEDSGVASKRRRIMLYEQQRGKCPYTGRDLPSNPLDPSLEIEHIFPVEMGGLSVDDNLVLTWRSVNAEKGKRTPLQWAGERFDAMLANTRDMRWSARKREIFAWGTIREDKPDKPSHYNADGTLRVPDFGNTTRTAQLARQLRAEIMRWMQVDDKPDEAARRIGTPSGWLAAQARKSWLPAEEYEKVRNNVTHHLIDAAILAHIPPREGMNSVRCKGIFYVESVPVRDPVTGDTTYRLETKALPELSPLPRLKHWLPDNGEYDVCPVWKPRRQSKTQSLGDSTFWRQVRPDEATVAQRTALKPEEITDADELLTTLQRMNIPAKLIPSRSALADWLAAATAATKADKDKPIAPLKLTDGTPVKNLWKFDSKGSFSSPVGWSGKRNPDGKLRELRTISLKYDRLELWLGYDHQKAERARRAKQPDWEQAGWVYQKRLIPDARALRHVKQMGFSFARDKRHKAPAFMQNKPDKPETHQTLRDLVLGGRLLPFSHKVGEIRKGDVFKLHLLPDGSIRKRTPVGQPEPAAALSTFYVVTALKHGRGNPVVKLTSQLFKDKEGTPMERFAGDVLSKILSTADDLAYVLGLPPAAEEAQKHGWRIPTSPPPPAAAAKETDGNLL

SEQ ID NO: 8 - protein, 1200 aa, unidentified; identical to SEQ ID NO: 7
  REGION 1..1200: note = Description of Unknown:uncultivated organism
  REGION 1..1200: note = MG1-13 effector

SEQ ID NO: 9 - protein, 692 aa, unidentified
  REGION 1..692: note = Description of Unknown:uncultivated organism
  REGION 1..692: note = MG1-3 effector
MGYGVKEKMKHFHYSIPRTQEKLHYPNKYKVTKAQWKKWCEEKGYKINLGTSEIPAPKISGRTGFSRPTMLLLREFILSGLGAQDFREKILTTNFKGFEKFKLQEEDLDFLKNIKNNDPQNIYLPNNSLKEKFLNKNTGDMEEAVQKLIGSTRHSVVRHRLTIFFKELQKLEKKFGAPDQIVIEFAREDFSTKDSKKKYENDSKENNRIFEAAKKELQEKFGIDYRRQNENLVRKYMMWEKQGYTCPYTGQALSFEKLPEYEIEHIIPRGNKWNGPDDIKNTVLTTGTENRKKGDNMPFEYIKNEEWEAFKERVNNMKISGKTKNILFARTKEEAEKLIDRYYGLATTGWVARMARDIACLWFGWQPNAEGEKRKLHTVSGSLVGKVRRKFGLNKALNPFLSEADAGKDEKNRDDKRHHALDAMVMTYLDEYMRNPRNFSKLQKELGEMFGKLGGAQYFEERLAEVTPYKIARNKAKLGETAYRKIEVQEKIIKRGKPEIKKEEIIVTRKNIEDAKPKEIIDKNIAKKIDDFLNKKPSEEEKKEFYKKLGIKKITVKKGKPDNLKNLSKNPNARGQYYESKSITGTGTLQHGVYLYSRDGENWKVEPVYAFKSPYKTKKELLEQGFQIKDNALFYAGCIIEVTENIEGKDIDRGKYTAMTIKTAGTIKLRNYKGDIIQTSLPQLKNNFHFIK

SEQ ID NO: 10 - protein, 692 aa, unidentified; identical to SEQ ID NO: 9
  REGION 1..692: note = Description of Unknown:uncultivated organism
  REGION 1..692: note = MG1-3 effector

SEQ ID NO: 11 - protein, 1271 aa, unidentified
  REGION 1..1271: note = Description of Unknown:uncultivated organism
  REGION 1..1271: note = MG1-8 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVKQARAQGKTPEELEAEEQKQLEQADPRYREAAGKWPEFKRAVPAEFHFPCYYDAFHMGLWSPDQPDQLRLRLDHRAASTRNVRFDRANVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRILAPCVLIPRYHACKVYARLEKDRAGRLTGKLVPDSLLASEVTFLLKLKNLLVADPVKGQRKLTVEEVRDIFAFAQRRLKTLPLFTPEGEPAKEWPSKVANCFAINPSDWPKIAVETECLKGLARLTVSDNGAPRPLTREEAEALLHAVAGGRRAAQSALPAHLLPLVKRAAAAWKQAKQQAGEIMLRPLPGHEEVKAPRTSGRSAYSRVALRILKELILSGDAPSAFHARLVRRDPDLLQRLGPAPGQPLAIFDDSTASNEAQRKQHDAENRKRGLLVSELNFLLQMRKDDGSPDSWENLFIPAQTLEALQQRHTEDGRLDADAAVRELLGTIKDPLVRHRLGVFDERLRKLRFGDARKGLRGFGVPEAIVLEFVREDFMGEQAKRELQTFQKRREQARAEAEAEAAKLGLESRSSALRYELFKAQGGICLYTGRPLSETQLDQYEIDHIVPRSLGGPDAMVNYVLTFPEVNSAKEKGKLTPYALLHGTDGWDAYVARVKARAAALRNKKVQLLTREDAPELVERYTALAETAWISKLAQTIVNLRFGWRNGVDYSGPQPVKRVIVVSGGLTARVRAKYGLDKLLYGENTPPEVLAKKVKNRDDDRHHALDAMVMTFIPHWARDPNKQGFFRFPPAFRDANGREDYQQIQSLFARQLEKIVPRHLAYEPCALADTIYGRRLDKGEPVIVQRVPVRELAYKQEQQRPVFNLTYAKDQIAHLRDPRLRRVLEALVATGPDQVAWDNYCRALAAGTCPELPGRKVLKVTLNRDEDPAEFKDLSKDGCGAFRTRKGEHRGQFVYLDARGRVRVRPVRPFESLVAVKAEVERLAAGGRLIGFFQSMCPVELDQPVTHGNFVLRPGTYRLNTIKKDGRAQVTTAAGEKTPQINLAKLVAAGFRRIA

SEQ ID NO: 12 - protein, 1655 aa, unidentified
  REGION 1..1655: note = Description of Unknown:uncultivated organism with predicted taxonomy: Verrucomicrobia
  REGION 1..1655: note = MG1-9 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFARWQRDGWTFRHPVTREALTKPVRARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSDLLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRTKEDFFRFPTAIGDNDFYSKEDQPEMAAIKSQLAKLYVENKPVFREIKQARLAGDFGRLQQLKASVFPARKRIAELYRALDKLKQPRNVRAVREWFRAQLEGASPAPNGPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYAWNPDHLAETARNILRKDDAQARTRGRRRTPAPASSPSADASPWPGFLWDREMQAKLASPKFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 13 - protein, 1147 aa, unidentified
  REGION 1..1147: note = Description of Unknown:uncultivated organism
  REGION 1..1147: note = MG1-10 effector
MTHYYQFNSIPDAVSPNSESLEQLKSASARYWAEHDFFSSDTVVLGLDIGMEGIGICVRKGKDILYCKSLLVDLPESEALAKRRAFRASRHVRKNRRRRMRLLKDLFGQYGLPWVDDSIMSRSDPYILRHRAVSKKLASKEALSICIRSLVARRGYDYDAMKEQGNNPWGDSNSVKEVMSWLKTTFVDEKMVQFIKEREEELTEGKGAPLKEETREKLWELLQARKAASDKQDINAMTAAYAKQRISERQAKGMNYPRSMVRKNLEEIIDRHAHLIDDVEGFKASLFRPCVTKEDKGKAIFYYQRKTAEENRLHFEKKVKDCPLAGWLQLGDENSKCCLKGNAWFRLWKLVDFLSVRRFYLKKKEKGSVPIRRLLPASVIESLVKASVHQDDHHFVSGWKDVKAVLNESLACEGWMAIDKGGDVKDQKDWNKEQLIALQDLCSPSASSRQARASLGEASARKLYYMVTQNESNFDPECMEEQKKNCGLYEQRQAISLFGGTFPQVAALLGTIGPDKKNKNGRFVQKTTGILQRIFADLSPMIGGKKVPDYVVVECIRQAPRTETQKKEIEVEQKNNRASKDKMASEFGVGEGKLGRSKYFRIALWKQQGGSKTTKAICPFTGKTLDVDDPLSPQLELAHLYPDTKGGLYMMDNLVLTTREVNKAMDNMTPVEAARAGIFGISCDEMIRRSEQFAWGESKRKLFRFEPTAEESFPDFNNMTRISQLASQLRKQVAFWLGIHADSDDLSAAVALRERIGNPQGQYTAAMRRSLLPESGKDRSGYVHHREDAALLSCMPPMGLNSIKYKGIFYTKMVPWLDSSGQLQQRRSLFALSCADGLPLPDIASILEDDTECPIIKRRSESKYKALGDSTFWHVDEEGNTWQRTPLVLGKDTSADSLHAMLVASCIPENLIPSQSEIDKWISHHTPAHRGEEIKNIPLRLKNGVPVKSIWKEASKGTLINSPMGWSGTMSDDGIFREARSLRSSNDRLELWIGWNAKKQVWEYQTRVVPTREAMAGIRRMGLPWRNTKNIPPYLQKILKQKKVSSLKELISGKLCPHSIHVADIRKGMVAKIEFEYDVKKCPSDKNGLKEVMWGEVTAILTSGKVECKSLIRKDMKPYSATNSLKIAMLFGFPPPDEFAKTHSLKP

SEQ ID NO: 14 - protein, 1206 aa, unidentified
  REGION 1..1206: note = Description of Unknown:uncultivated organism
  REGION 1..1206: note = MG1-11 effector
MNNTPLSPNTASAEPEPDRKLAAESAAENAQARAVAASWAQHPFFDDESIVLGLDIGMQGIGIAVRRGRQLLYAKTLMVELPESAPLRQRRQYRAARHARKNRKTRMRRLRELFLRHGLPWVSDEIYGRSDPYKLRARAFTPGKTLASKEALSLCIRSVVAHRGFDYYALCSESGGYPWGESSDMKDAARWLRTQYVTEETRDQLIGMAGAFSCFDEKEITDNHLLEWERLVRERCDDPNKPDLATLLRQYASSRPDDRRARGWNFPRSLMEDHLRTIINKHRHLIDDCDGFLAALFRPCDTKADKKRAIFHYNRKTPAEARARFERKIALCPYLSDPETAISLGHADAEGRPLPPEKCGTRGEAAICRWSMLDFLSTRRFELKPPKARGKDLAEPPLLRQTLPEATIRALDEALQEPVKPRWADLKSRLTKALKPFTLETNTKSPTNALLIEQLKDICCPSGPKAAARAGLSARAAELLIGVITGRSNPAGEASDTPPAPSYDPRQLEERKLAWGLYEKRARIDASRTGIYPQVHTLLGTLRVHRKSAEDSAFSTRGLLQRLFEGELRESLGGKTRPDYCIIECIKNPACNTKQASEIQKQNDARRKRKEELCRAYGCANPTHAEMLRLQLFEEQGGKRKGEAPAICPFTGESLGTDPLSPHLELAHIFPDARGGLYIRENLVLTTARTNRDMNNRTPIEAAEASLPGWSRWETIEQRIRHFRWNAKKLELFTFRPTPEQPIPDFNNMTRTAQLARELRRYIAVWMGINRDVDAVRERIGNPCGSYTAAARRGMLPADYRKDRSNNLHHRIDAAVLTCIPPAAGLNNLRCGGIFRNTRINGKRCTTTIPGLPLPDFGALIADDSTCPLVSRRRTGSTRQSLGDSTFWGVNSQGDLTQRTPLVYDKDTSVESIAQDLVRTGIRAEEMPDQDHIEQWLLRMSQAQQEEREGRDAAGPAPTLRLKNGRPIRSIRKGSKKGEIAVSPLGWSGIIEPRSESPAGDGAPAAEATSGRGRDRNRAAITAPNRFIALRCLSSSNDRLELWLGHDGKKWKYVTRVIPTKQALAGLKRMGLPWRGRERAPLYLIRLLDAARCRDLKQFICGTLPPHAVKVATVRKGDFFRATFNLKPKKREEQHSHTACLDTPATLTGWGKVTALMTKGQIGISPATHQGYEKTSVRGPSRLAKMLGLQEDAAAEAESRGLLPRP

SEQ ID NO: 15 - protein, 1244 aa, unidentified
  REGION 1..1244: note = Description of Unknown:uncultivated organism
  REGION 1..1244: note = MG1-12 effector
MDYIIKPAPGSTSSPYDWANDPFYKSAIVLGIDIGIEGIGVWLRKGRNHVFARTFLFNTPEAAPLKGRRLLRGGRRCRQSEQHREVLLKQFCAEFGLPWTEIKDQENEDGPFKLRLRAVRSKLGSKEALVVCLRHIIRHRGYDYHETDGGSFPWGDELKADVATGWAKAAYCSPEDAAEFLHDVSDCGWNDKQLASFRHALTAAVERHKQGIEAALEKHFAQDKNNLRIPARKHNFPRSLIWKHMEKICANHRDFLGGEAGLSAALLKLKPILNYHRKKPGALAERKVNRCPVAIHLFGGTAPKCDPNSNPHIRRFKLLEFLATRSFVAKDGTRLLANADLMKWLLDEVLAEDIRAVVVNKVKGGQKQERRKFGGFRDEFIARFDPNGKIELAGDRVSHNKDFFEQLGDLLRPKLSVLNARASICGKSAEELFKRATKDGYQAEIISRNLKEKQFDGQSFYTLRQAAAAGFGIYPQVEFLLGRRGKKGNQAVPGVLRQMLELPEVSAKLDGQKIPDYVIIETVGDMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIAQLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNRSKKSRFQQWIYGFPDKNGQMWARDSLKSLADKANLLELLRDAGIGENQLPTSHFEEWQEKRKAQFFTREEAWAAVEALALPPEQKIPEPIFEEWWSYRFSGDKRKVDEKLLRILIAKAGVKESVSKERLASVLTNRGDPGPLTRKDGTPINGVSGTAKQMTPMAIIPHRNHKREIIGFKLATESFVRAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 16 - protein, 1294 aa, unidentified
  REGION 1..1294: note = Description of Unknown:uncultivated organism
  REGION 1..1294: note = MG1-14 effector
VWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENFFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTALAETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFERAALADTSFGLRVEGGKRIIVKRVSLFDLAQEPAGAPGKTKFSSKYLLKKIEWVRDATIRRRVKEEFLHKEPTEPNWQKFCDSFRQNSRNGVPGARIMKVWVYAGEPNEFKDLSKDGEGAMRKAKDDHQGQIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 17 - protein, 1010 aa, unidentified
  REGION 1..1010: note = Description of Unknown:uncultivated organism
  REGION 1..1010: note = MG1-20 effector
MNTKKIIFGFDVGLGSLGEAVRQGDKIIHADSLLIDKEVAEIKDQAERRRQYRTRTTHKEREKWWKKIWKMIGKQPLKGIEVFKDKNGNWQAEKGDEKLEREFPKKGDDTVYTSCLLRILLLQGEKLKDWQIYKAVRSAFMRAGYPNVPWAKQDEKEEEKRATEFTEMLEKIFTNLDYRFPCYYDAYQMEIFDAETGEIEIRQKKKANRARGYTAPRDLVEKELRLLLEQAAKQIPDLKNMPAKDWKDYILFGLKGDEKLQNKQWKGFYDTKIRGILDQKKAKFDNRCVNNCSQIPRFRVSRTKNILYFQTHLLLKLCNMMVEKNKKNEKLTPEERQEWYEKAEGERKQYMKDFFAKGGKKLTEDDYKKIANKYKITKTQWKKWCEKKGYKTYPGTCEIAAPKISGRTGFSRPAMLLLREFILSGLGAHDFRKKVLLENFKGFEKYKLHKEDLDFLKNIKGNDPQNIYLPSISLKEKFLDKNTGDIEDAVQKLIGSTRNSVVRHRLSVFFKRLQELEKKFGTPDNIVIEFAREDFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGLAVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNKARLEAQAISSVKKKISELKKTDIESIIDYKMKIEIQEIGLKNFQKKHSKEQKILLKPNGAINLSKDKKSRPRWYVTKTGEGFSYEGHYIFKERNNENFKICPVKAFESSWQVFRKLKNKGYEIKDNALFYAGCIIEITKPIPKKDIDVGFYEIKSLKPSDHRIQLKSLKRGEVFPLFAISYLKNNFHFVQ

SEQ ID NO: 18 - protein, 774 aa, unidentified
  REGION 1..774: note = Description of Unknown:uncultivated organism with predicted taxonomy: CandidatusPeregrinibacteria bacterium CG10_big_fil_rev_8_21_14_0_10_54_7
  REGION 1..774: note = MG1-21 effector
EKLEREFPKKGDDTVYTSCLLRILLLQGEKLKDWQIYKAVRSAFMRAGYPNVPWAKQDEKEEEKRATEFTEMLEKIFTNLDYRFPCYYDAYQMEIFDAETGEIEIRQKKKANRARGYTAPRDLVEKELRLLLEQAAKQIPDLKNMPAKDWKDYILFGLKGDEKLQNKQWKGFYDTKIRGILDQKKAKFDNRCVNNCSQIPRFRVSRTKNILYFQTHLLLKLCNMMVEKNKKNEKLTPEERQERYEKAEEERKQYMKDFFAKGGKKLTEDDYKKIANKYKITKTQWKKWCEKKGYKTYPGTCEIAAPKISGRTGFSRPAMLLLREFILSGLGAHDFRKKVLLENFKGFEKYKLHKEDLDFLKNIKGNDPQNIYLPSISLKEKFLDKNTGDIEDAVQKLIGSTRNSVVRHRLSVFFKRLQELEKKFGTPDNIVIEFAREDFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGLAVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNKARLEAQAISSVKKKISELKKTDIESIIDYKMKIEIQEIGLKNFQKKHSKE

SEQ ID NO: 19 - protein, 774 aa, unidentified; identical to SEQ ID NO: 18
  REGION 1..774: note = Description of Unknown:uncultivated organism with predicted taxonomy: CandidatusPeregrinibacteria bacterium CG10_big_fil_rev_8_21_14_0_10_54_7
  REGION 1..774: note = MG1-22 effector

SEQ ID NO: 20 - protein, 809 aa, unidentified
  REGION 1..809: note = Description of Unknown:uncultivated organism with predicted taxonomy: CandidatusMelainabacteria bacterium
  REGION 1..809: note = MG1-23 effector
MSKKVFAFDLGKASVGYCVREGFDIRKVGSIIIEKDHAEITTNRDRRRVKKTLEAHKAREQFFKKLWQNAGLETLDKEDERFKKEFGNKKDKNIYTSCLLRIALLQNKKLEQWQIYKALFNAFQRRGYDANLAWANAKTDDDKKNAEYMAKYTKENNVELINNDDFKFPCYYDAKRLGLWSEENPSELKTTIPLTGSKKVRTNGLVAPRELVEKELKQLWLNAQKQLPQLQNIDAEYFLYGDYRQAYGSYVVKEFRKFRGTKNDWQGVLGQKIPRFDNRIIAKCKLLPKRNVCKANTLENVSLVLLMKLKNLRLTDNMGEKFLLSPIDIKKIYENWLIKAKIDTNEEKLDTTITKKEIETVLNRKIKDKIDPMKANISGRSSFCRRACKIMTKIILSCELYPQNVDITEFVDKPNTQNPITIEEINTMISKIGDWNNLYIPDNRDEMAENSSDNREQTDTLIGNITNPIVRNRLQIFRDLILNLKQEYGTPNEVIFEFVRDGADNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGLAETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDKTFKGNIKPLESIYGKRVKNGNTYLTKRADITSLEPKE

SEQ ID NO: 21 - protein, 1036 aa, unidentified
  REGION 1..1036: note = Description of Unknown:uncultivated organism
  REGION 1..1036: note = MG1-24 effector
MGKKVFAFDMGKTSIGFCVREALEIKEANSIIIDKEHSDISSIRERRRVKKNLEAHKAREAFFINLWKSCGLIPLDTKDENFKKEFATKHEDVIYTSCLLRIALLQNKKLEQWQIFKALYNAIQRRGYDTNLAWKSAQSDDDKENQELVKKYTQENGIEMIQNEEYKYPCYYDAKRLGLWNETTPKVCKRTLNNENLIKIRTTTYVAPRQLIEKELCNLWKNAQAQIPELNKYTVEEFLYGEYKEPYGSFVNPKFKQYMGTNHDWQGVLGQKIPRFDNRIIAKCKLLPKRNVCKANTIENVSLVLLMKLKNLRLTILDGSKRILAPAEIKHIYENWLSKVEQNVIKMQEKCKKENKTPDKEDKKLDTTITKKEIENVINQVISDKIEPLKANISGRSAFCKRACQIINKFILGGYLYPNEMDITEFIDSENRPNGITKAEIQNMLSKIGDWNNLFIPDNRGETIDNSENIRVKTDLMIGGITNPIVRNRLQIFRDLLLSLERDYGKPDEVIFEFVREGADNSLFGKAKAQAAETNMREMEKRNQQLIEELKNYDAYSSKNFEKLKLLKIQCGQCAYSGEKIGIGDFNKCEIDHIYPRAMGGNDALYNKVLCYRVENQKKQDRTPYEWLSSNKEQWANYVFRLNKIKQSLGKKKFELLTSKPEDCAKLIDSYNGLAETAYIARVAQQITAFCFGWGLQVEGEKRHIFVNNGSSTHAIRRRYGLNSLLGNDIKKNRDNDKHHALDAICISFSRDFKYDEKSKVDVIDGFTKEMVKKVLDEIIPYPYTNKKPFKGNIRPLETIYGLRTYGNNSYITQRIPLESIEQKDKKIKTIIDEAIKNDLLEKLTQKMDSKDWIKMLQNYVHPTKKTKVKKVMVVVSEGKIEKDSNGKERIGEFCDFGTKGTNHQFKHSKGHKGQILYFNEKGSVKVMPIYANIKTQDVKDKLLALGCKLYNKGEMFYSGCLIEVEKPFNATVYYKETDENGKDKTISVKQEVPAGIFKLRTIMSNGAIKLENNCGMEILSSAKVLVEANMKKYKN

SEQ ID NO: 22 - protein, 1027 aa, unidentified
  REGION 1..1027: note = Description of Unknown:uncultivated organism
  REGION 1..1027: note = MG1-25 effector
MVKKIFAFDMGKSSIGYCAREGLKVLELGSLIIDKDHAEIVSNRDRRRVFKTLNAHKAREKFFNDLWKSCNLEPLEKEDKLFKKEFGKKDEETIYNSTLLRIALLQNIELEEWQIYKALHSAIQRRGYDTSLAWANANTDDEKENKKRTLEYTTNKENDELISQEEYKYPCYYDAKRLGLWEEENPKTLKTYVDVYNNDKIRTAGIVAPRNMVEKELKQLYINAQKQLPELNKYSADYFLYGVSEKAYATYLDSDYKKYRGTNWEWENGGVLGQKIPRFDNRIIAKCKLLPKRNVCKAETVENVSLVLLMKLKNLRFTDVLGEKSMLSAEAIKQIYENWQKKATKNDGSIKLDTTITKQEIEKVIGEKILEKFEPMKAKLSGRSSFCRRACKIMCKIILEGIENPATMDVGEFIDNIDVKNGITEKEIRTMLSKIGTWDNLYIPDNRYEMAEISSDEREKTDILIGNITNAIVRNRLQIFRDKILELKYKHGTPDEVIFEFVRDDNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGLAETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDKPFKGNIKPLETIYGYRKLGEKTYITQRVDITSIEQKDKKIKSIIDEIIKNDLLAKLEDKMTSKEWANMLSKYVHPTKKTRVKKVLLVVSEGITNFDENGRARIGEFVDFGTKGTKHQFKHSKGHKGQILYYNEKNAIKVMPIYANQKLGEVKDKLEQMNCKLYKKGMMFYSGCLIKVDKEFEGTAYYTIADENGKEKQTPKKEILPAGIYKLRTLKSDGRVQLESSVGIEIWTNAKNLVDTDFKKLTK

SEQ ID NO: 23 - protein, 1025 aa, unidentified
  REGION 1..1025: note = Description of Unknown:uncultivated organism
  REGION 1..1025: note = MG1-26 effector
MKKKVFAFDLGKASIGYCVREGFEINEANSIIIDKDHAETMSLRDRRRIKKTLDAHHAREEYFNKVWSGVGLNILDKNNNNFKKEFPSKNEDIIYTSCLLRIALLQNQKLEQWQIYKALYNAFQRRGYDVNIAWKSVQTDDDKENIERMKKYTCENDIELIISDEYKYPCYYDALRLGLWNEDEPTKLNHSIPQHNSNKIRTTEYVAPRELVEKELKQLWLNAQLQLPQLNSISPEEFLYGEYKVPYGSCTEKEFKQYRGTERDWQGVLGQKIPRFNNRIISKCKLLPKRNVCKANTLENVSFVFLMKLKNLRFTTVSGEKLRLSPTEIKQIYENWLLKVENAYDKDIEKANNLGKEKPEKRLNINITKKEIENVICNEIIDKIEPMKADISGRSSFCRRACQIMNKIILDGELYPQNVDISEFVDRDNVKNGITEEEIQSMLSKIGDWNNLYIPDNREENAQNASNSRTKTDIMLGNITNPIVRNRLQIFRDLLLDLAEKYGTPDEVIFEFVRDGADNSLYGSKKAQDTEKYMKQQEKENEQIIKELKEAGLYVNGQNHANATYFLMHKLLKSQGGACAYSGQKIAPSNYDECEIDHIYPRTLGGNDALYNKVVCYRRENQDKKGRTPYEWLSSDNDKWANYVNRLNKIKKQLGKKKFELLTSKPEDCEKLIESYNGLAETSHIARVAQQMTAFIFGWGLQVQGKNRRIFVNNGSSTCAIRKRYDLNKLLGDDRKKNRENDKHHALDAICISFSRDFKYDKEIKKDIIKGFNPEIVKDAIDKIMPYPYANDKPFKGNTKPLETIYGLRTYGEKSYITQRVELNSIDKKATKIKSIIDETIKNDLLNKLEENPTEQEWKLMLQNYIHPKKQTKVKKVMIIVSEGEITKDSNDRERIGEFVDFGTKGTQHQFKHSKGHKGQILYFNQKGIVKVMPVYSNIKITDIKDKLQNMGCKLYNKGQMFYSGCLVDIPKPFKAGSKEHPAGCYKVRTITLGGQIKLEDNCGIEILTSATYLVQAGFKKVESK

SEQ ID NO: 24 - protein, 1028 aa, unidentified
  REGION 1..1028: note = Description of Unknown:uncultivated organism
  REGION 1..1028: note = MG1-27 effector
MNKKVFAFDLGKASIGYCVREDLKILEAGSLIINKDHAECISNRDRRRVQKTLLAHKKRESFFNNLWQNCDLNILNKDDKRFSTEFGKKNDSTIYNSTLLRIALIQNKPLEEWQIYKALHNAIQRRGYDSKLPWANAKSDDDKKNEELSARYTQNEQGEELIKNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSMLSADTINKIYQNWLNKALKDDGSYKLDTTIIQKEVEKVLGEKIQDKFEPLKANISGRSSFCRRACKIMNHIILNGIEDPTTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGLAETAQIARVAQDITAFIFGWGLQLKDEKRRIFVNNGASTSGIRKTYRLNKLLGNDVKKNRNNDKHHALDAICISFSQNYKYNKHTKRDEIEGLDIHDNEFRELIKQTLDAIIPYPYTNDKPFKGNTKPLETIYGYRCIDNKHYITQRVSLETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSYIEQNGCKLYKKGMKFYSGCLIQINKDFEATAYYTQTDENGNDKQIPTKEKLQAGVYKLRTMMIDGKVKLESSTGIELLTNAKVLVEADFSKFSKY

SEQ ID NO: 25 - protein, 1036 aa, unidentified
  REGION 1..1036: note = Description of Unknown:uncultivated organism
  REGION 1..1036: note = MG1-28 effector
MGKKVFAFDMGKASIGYCAREDFEIKEANSIIIDKDHSDISSIRDRRRVKKTIIAHKAREQFFVNLWKSCNLTPIDTKDDNFKKEFANKKDSTIYTSCLLRIALLQNKKLEQWQIFKALYNAIQRRGYDANLAWKSAQTNDDKENIELTQKYTQENGIELIKNEKYKYPCYYDAKRLGLWDENFPNRFNQAINLDNVIKVRTTTYVAPRQLVEKELKQLWINAQIQIPELNKYSVEEFLYGEYKEAYGSYVNPEFKKYMGTAHDWQGVLGQKIPRFDNRIIAKCKLLPKRNVCKANTIENVTFVLLMKLKNLRITNNLGEKIILSPEEIKHIYENWLSKVEQNVIKMQEKCKKENKTPDKEDKKLDTTITKKEIENVINQVISDKIEPMKANISGRSSFCKRACQIMNKFILGGYLYPQEMDITEFIDSENSPNGITKQEIQVMLSRIGDWNNLYIPDNRGENINDSEKIRTNTDLIIGSITNPVIRNRLQIFRDLLLSLEKDYGKPDEVIFEFVREGADNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGLAETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKKPFKGNTRPLETIYGLRAYNGKSYITQRVPLESIEPKEKKVRTIIDEVIKNDLLEKLNQKIDSKEWISMLQNYIHPKKKTIVKKVMIVVSEASIEKDSNGVERIGEFCDFGTKGTKHQFKHSKGHKGQILYFDEKGLVKVMPIYSNIRTQDIKDKLMTMGCKLYNKGEIFYSGCLVEIEKPFVATVYYKETDADGKEKTISVKQEVPYGIFKIRTIMGDGKIKLENNCGLEILSSAKVLVPLNMKKYKN

SEQ ID NO: 26 - protein, 1036 aa, unidentified; identical to SEQ ID NO: 21
  REGION 1..1036: note = Description of Unknown:uncultivated organism
  REGION 1..1036: note = MG1-29 effector

SEQ ID NO: 27 - protein, 1036 aa, unidentified
  REGION 1..1036: note = Description of Unknown:uncultivated organism
  REGION 1..1036: note = MG1-30 effector
MGKKVFAFDMGKASIGYCAREDFEIKEANSIIIDKDHSDISSIRDRRRVKKTLNAHKARERFLVNLWKSCNLIPLDTKDDKFKKEFANKKDSTIYTSCLLRIALLQNKKLEQWQIFKALYNAIQRRGYDANLAWKSAQTNDDKENIELTQKYTQENGIELIKNEKYKYPCYYDAKRLGLWDENFPNRFNQAINLDNVIKVRTTTYVAPRQLVEKELKQLWINAQIQIPELNKYSVEEFLYGEYKEAYGSYVNPEFKKYMGTAHDWQGVLGQKIPRFDNRIIAKCKLLPKRNVCKANTIENVTFVLLMKLKNLRITNNLGEKIILSPEEIKHIYENWLSKVEQNVIKMQEKCKKENKTPDKEDKKLDTTITKKEIENVINQVISDKIEPMKANISGRSSFCKRACQIMNKFILGGYLYPQEMDITEFIDSENSPNGITKQEIQVMLSRIGDWNNLYIPDNRGENINDSEKIRTNTDLIIGSITNPVIRNRLQIFRDLLLSLEKDYGKPDEVIFEFVREGADNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGLAETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKKPFKGNTRPLETIYGLRAYNGKSYITQRVPLESIEPKEKKVRTIIDEVIKNDLLEKLNQKIDSKEWISMLQNYIHPKKKTIVKKVMIVVSEGSIEKDSNGVERIGEFCDFGTKGTKHQFKHSKGHKGQILYFDEKGLVKVMPIYSNIRTQDIKDKLMTMGCKLYNKGEIFYSGCLVEIEKPFVATVYYKETDTDGKEKTISVKQEVPDGIFKIRTIMGDGKIKLENNCGLEILSSAKVLVPLNMKKYKN

SEQ ID NO: 28 - protein, 1028 aa, unidentified
  REGION 1..1028: note = Description of Unknown:uncultivated organism
  REGION 1..1028: note = MG1-31 effector
MNKKVFAFDLGKASIGYCVREDLKILEAGSLIINKDHAECISNRDRRRVQKTLLAHKKRESFFNKLWQNCDLNILNKDDKRFSTEFGKKNDSTIYNSTLLRIALIQNKPLEEWQIYKALHNAIQRRGYDSKLPWANAKSDDDKKNEELSARYTQNEQGEELIKNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSILSADTINKIYQNWLNKALKDDGSYKLDTTIIQKEVEKVLGEKIQDKFEPLKANISGRSSFCRRACKIMNHIILNGIEDPSTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGLAETAQIARVAQDITAFIFSWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDKPFKGNTKPLETIYGYRCIDNKHYITQRVSLETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSHIEQNGCKLYKKGMKFYSGCLIQINKDFEATAYYTQTDGNGNDKQIPTKEKLQAGVYKLRTMTEAGQIKLESSTGIELLTSAKVLVEADFSKFSKY

SEQ ID NO: 29 - protein, 1028 aa, unidentified
  REGION 1..1028: note = Description of Unknown:uncultivated organism
  REGION 1..1028: note = MG1-32 effector
MNKKVFAFDLGKASIGYCVREDLKILEAGSLIINKDHAECISNRDRRRVQKTLLAHKKRESFFNNLWQNCDLNILNKDDKKFSTEFGKKNDSTIYNSTLLRIALIQNKPLEEWQIYKALHNAIQRRGYDSKLPWANAKSDDDRKNEELSARYTQNEQGEELIQNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSMLSADTINKIYQNWLNKALKDDGSYKLDTTIIQKEVEKVLGEKIQDKFEPLKANISGRSSFCRRACKIMNHIILNGIEDPSTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSNPENCKELIKSYNGLAETAQIARVAQDITAFIFGWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDKPFKGNTKPLETIYGYRCIDNKHCITQRVSIETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSYIEQNGCKLYKKGMKFYSGCLIQINKDFEATAYYTQTDKNGNDKRIPTKEKLQAGVYKLRTMTEAGQIKLESSTGIELLTSATVLVEADFSKFSKY

SEQ ID NO: 30 - protein, 1028 aa, unidentified; identical to SEQ ID NO: 28
  REGION 1..1028: note = Description of Unknown:uncultivated organism
  REGION 1..1028: note = MG1-33 effector

SEQ ID NO: 31 - protein, 1025 aa, unidentified; identical to SEQ ID NO: 23
  REGION 1..1025: note = Description of Unknown:uncultivated organism with predicted taxonomy: CandidatusGastranaerophilales bacterium HUM_9
  REGION 1..1025: note = MG1-34 effector

SEQ ID NO: 32 - protein, 1027 aa, unidentified; identical to SEQ ID NO: 22
  REGION 1..1027: note = Description of Unknown:uncultivated organism
  REGION 1..1027: note = MG1-35 effector

SEQ ID NO: 33 - protein, 1011 aa, unidentified
  REGION 1..1011: note = Description of Unknown:uncultivated organism with predicted taxonomy: Clostridium
  REGION 1..1011: note = MG1-36 effector
MRYRIGLNIGINSCGWAVIEHNEDGEPIKLENMGVRMFEISENLKDGLSLSKAPRETRSIRRRIRRRKHRIERLKYLIVNSNMLTQEEVNNLYNSTNLENIYLLRVRALSEKISNTDLTRVLINLMKKRGYKSNVELEDYAKDEDGKVLTATKENQKIMKEKGYSTVAEMYLKDKKFKMILPDGTIIYKIRNTTGNYSSTVLRNQIREELIRILIKQQELNDLVTNDFVQKCLEIFDSQRPYDEGPGLRYSTTQVDKMLGKCIFEKQENRAVKASYSFEYFDFLKQLNNIIIEKTIITSNNKTTQKRKLSKEERQKIIKLAKYQSQIRYYDIRQELQLSDYERFCNLEYSSISEFSESINKLAERKPKLEGFTSYFRIKQALYYVDNTLIERLSNEELDEIAYVLTVYKSNERRLEQFEIRNLHLPANAIQELLKISFIEIAYLSLKAIKKITPYIEEGYTYNSALEQAYPSFETSLCNINSEILNPVCRRAISQSIKVLKAIVNQYGKPDLINIEFSNELGKGKSEREKIKKQKQENLGKTSRIKEELQAQGIENPTGTEITKYKLWKEQTNYCMYSGKKIDIEQVFSSETQINYIIPFWMCFDDTYKNKILTFTSEVKQKQDLMPYQYIQKMRRDTEEYETRISMLIRVYSKKNRLVKKNITKEEMIKWRNRNIEDTQYIAKWITNYIRRNIQFVECSKYNNKVLIISSNLTSYINRKLDISNNIIIGNQKHALDALVTATVSKELLNKIIIYSRENTENSQFPIPWENFKQDMNNLPPIFVSRAPKRKVTGQAHDETIRRMQICGKEIKCISRTDIKKLKLNSEGEIENFSKNSKNTDKVLYNALKEEIKENGGNATRSFIKQFYKPKKDKTPGLPVKKVKLESKTRLPIKLKNQAIATNGSIIRLDVFKVENEGYYYVPIYVSDTVLPKLPNKACASSKPYEEWPEMREEDFIFSLYSRDLIYIKNKSPMNLHPTDGKRKHSNNRRNISVLHKGRYLRSNHKHNKQW

SEQ ID NO: 34 - protein, 1027 aa, unidentified
  REGION 1..1027: note = Description of Unknown:uncultivated organism
  REGION 1..1027: note = MG1-37 effector
MVRKIFAFDMGKSSIGYCAREGLKVLELGSLIIDKDHAEIVSNRDRRRVFKTLNAHKAREKFFNELWKSCNLEPLEKEDKLFKKEFGKKDEETICNSTLLRIALLQNIELEEWQIYKALHSAIQRRGYDTSLAWANANSDDEKENKKRTLEYSTNKENDELISQEEYKYPCYYDAKRLGLWEEENPKMLKTYVDVYNNDKIRTAGIVAPRNMVEKELKQLYINAQKQLPELNKYSADYFLYGVSEKAYATYLDSDYKKYRGTNWEWENGGVLGQKIPRFDNRIIAKCKLLPKRNVCKAETVENVSLVLLMKLKNLRFTDVLGEKSMLSAEAIKQIYENWQKKATKNDGSIKLDTTITKQEIEKVIGEKILEKFEPMKAKLSGRSSFCRRACKIMCKIILEGIENPATMDVGEFIDNIDVKNGITEKEIRTMLSKIGTWDNLYIPDNRYEMAEISSDEREKTDILIGNITNAIVRNRLQIFRDKILELKYKHGTPDEVIFEFVRDDNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGLAETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDKPFKGNIKPLETIYGYRKLGEKTYITQRVDITSIEQKDKKIKSIIDEIIKNDLLAKLEDKMTSKEWANMLSKYVHPTKKTKVKKVLLVVSEGITNFDENGRARIGEFVDFGTKGTKHQFKHSKGHKGQILYYNEKNAIKVMPIYANQKLGEVKDKLEQMNCKLYKKGMMFYSGCLIKVDKEFEGTAYYTIADENGKEKQTPNKEILPAGIYKLRTLMSDGTVKLESSIGIEILTSAKKLAEADFKKLTK

SEQ ID NO: 35 - protein, 810 aa, unidentified
  REGION 1..810: note = Description of Unknown:uncultivated organism with predicted taxonomy: CandidatusMelainabacteria bacterium
  REGION 1..810: note = MG1-38 effector
MSKKVFAFDLGKASVGYCVREGFDIRKVGSIIIEKDHAEITTNRDRRRVKKTLEAHKAREQFFKKLWQNAGLETLDKEDERFKKEFGNKKDKNIYTSCLLRIALLQNKKLEQWQIYKALFNAFQRRGYDANLAWANAKTDDDKKNAEYMAKYTKENNVELINNDDFKFPCYYDAKRLGLWSEENPSELKTTIPLTGSKKVRTNGLVAPRELVEKELKQLWLNAQKQLPQLQNIDAEYFLYGDYRQAYGSYVVKEFRKFRGTKNDWQGVLGQKIPRFDNRIIAKCKLLPKRNVCKANTLENVSLVLLMKLKNLRLTDNMGEKFLLSPIDIKKIYENWLIKAKIDTNEEKLDTTITKKEIETVLNRKIKDKIDPMKANISGRSSFCRRACKIMTKIILSCELYPQNVDITEFVDKPNTQNPITIEEINTMISKIGDWNNLYIPDNRDEMAENSSDNREQTDTLIGNITNPIVRNRLQIFRDLILNLKQEYGTPNEVIFEFVRDGADNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGLAETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDKTFKGNIKPLESIYGKRVKNGNTYLTKRADITSLEPKEK

SEQ ID NO: 36 - protein, 1028 aa, unidentified; identical to SEQ ID NO: 28
  REGION 1..1028: note = Description of Unknown:uncultivated organism
  REGION 1..1028: note = MG1-39 effector

SEQ ID NO: 37 - protein, 1028 aa, unidentified; identical to SEQ ID NO: 29
  REGION 1..1028: note = Description of Unknown:uncultivated organism
  REGION 1..1028: note = MG1-40 effector

SEQ ID NO: 38 - protein, 1025 aa, unidentified; identical to SEQ ID NO: 23
  REGION 1..1025: note = Description of Unknown:uncultivated organism with predicted taxonomy: CandidatusGastranaerophilales bacterium HUM_9
  REGION 1..1025: note = MG1-41 effector

SEQ ID NO: 39 - protein, 1028 aa, unidentified; identical to SEQ ID NO: 24
  REGION 1..1028: note = Description of Unknown:uncultivated organism
  REGION 1..1028: note = MG1-42 effector

SEQ ID NO: 40 - protein, 1028 aa, unidentified; identical to SEQ ID NO: 28
  REGION 1..1028: note = Description of Unknown:uncultivated organism
  REGION 1..1028: note = MG1-43 effector

SEQ ID NO: 41 - protein, 1036 aa, unidentified; identical to SEQ ID NO: 27
  REGION 1..1036: note = Description of Unknown:uncultivated organism
  REGION 1..1036: note = MG1-44 effector

SEQ ID NO: 42 - protein, 1025 aa, unidentified; identical to SEQ ID NO: 23
  REGION 1..1025: note = Description of Unknown:uncultivated organism with predicted taxonomy: CandidatusMelainabacteria
  REGION 1..1025: note = MG1-45 effector

SEQ ID NO: 43 - protein, 1036 aa, unidentified; identical to SEQ ID NO: 25
  REGION 1..1036: note = Description of Unknown:uncultivated organism
  REGION 1..1036: note = MG1-46 effector

SEQ ID NO: 44 - protein, 1028 aa, unidentified; identical to SEQ ID NO: 24
  REGION 1..1028: note = Description of Unknown:uncultivated organism
  REGION 1..1028: note = MG1-47 effector

SEQ ID NO: 45 - protein, 996 aa, unidentified
  REGION 1..996: note = Description of Unknown:uncultivated organism
  REGION 1..996: note = MG1-48 effector
MNKKVYAFDLGKASIGYCARDGFNILELGSLIINKDHAEVVSNRDRRRAYKTLQAHKSREEFFIKLWQDCGLPVLEKNDKRFTIEFSKEKDETLYNSTLLRITLLQEKPLEVWQIYKALHSAIQRRGYDANIRWANDSDDEKENQERVTKYTQDENGIQIITNDAYKYPCYYDAVRLGLWDEKNPLEYKKHIPLQGVTKVRTTGIVAPRSFVEKELTQLYINAQKQLPQLEKYSVNYFLYGKYGKAYATFHKQEQGKEKDYGVLGQKIPRFDNRIIAKCKLLPKRNVCNAGTIENVSFTLLMKLKNLRFTNANGERCMLDSSAIKEVYENWLKKANKDNEIKLDTTITKKEIENVIGFKIQDKIEPMKTNISGRSSFCRRACQIMNKIILEGIENPATMDVAEFTDNVDSPNGITEQEIREMLSKIGTWENLYIPDNRYEMAELSSDDRQKTDLLIGNITNPIVRNRLQILRDKLLELKAEHGTPDEVIFEFVRDGADNSLYGAKKANGYLKNIKENEKENNEIKKELEEANAYSPTNFEKLKLLRMQCGKCVYSGKNISINDFDSCEIDHVYPRTMGGNDALYNRVLCYSIENQNKAGRTPYEWLSSDKELWANYVARLNDIKGSLGKKKFELLTSKPEVCEKLIESYNGLAETAQIARVAQQLAAFIFGWGMQTEGDKRHLFINNGSTTAAIRRRYGLNKLLGDDIKKNRENDKHHALDAICISFSKDFKYDHKSKKDIIEGFTYDFVKNEIDKLIPYPYANDKPFKGNTRPLETIYGYRKYGDKNYLTNRVDITSIEQKEKKIKTIVDEVIKNDLLEKLNLSSGDWAAMLKNYKHPKKHTIVKKVLTIVSEGTITTDSNNKSRMGEYADFGNKGVKNQFKHSKGHKGQILYYNEKGAVKVMPIYANQKLSEVKEKLLAMNCKLYKKGIMFYSGCLVSIPKDFKGGSNDYSAGIYTLKTIIADTGVIKLENLNGVEIGTSAKYLTDAEFRKYKN

SEQ ID NO: 46 - protein, 1015 aa, unidentified
  REGION 1..1015: note = Description of Unknown:uncultivated organism
  REGION 1..1015: note = MG1-49 effector
MKKFFAFDIGKKGLGYCCREGSKIHCAGSLTIEPDHSSVEDIRNNRKAIKTRIFHKAREEYFNKLWHDEAGLEILDKDDERFKIEFSKQDDERIYNSTLLRIALLQNRELEKWQIYKALHNAFQRRGYDSELPWKNSGTKADEENEKLAKNYTQKNGQKLIKKEKFQYPCYYDALALGMWKERNPSDLQRIVSKNPQKIRTGRRVAPRKLVIKELTDLWTAAQKQIPELQKISADKFLYGEYREPYASYTNPDWHKNMGKEKDWQGVLGQKIPRFNNRIISKCKLLPKRNVCSADTIENIVFTLLYQLKNFRYTNSNGEVGCRLAPIEIKEIYDNNIQNWMKNLYDNKKNNKSHTFTVSKTEIEKVIGKGQIYTTKNEKFKSFQANTSGRSSFCRRALQIMNEIILTGTDPKDVNISKFVDKSTTNNPITEDEIKEMLTKVGDWNELYIPYNSTRMAEFAQNPDIQSDLMIGSITNPIIRNRLQIFKNLLNDMIKKYGKPDEVIFEFVKDGKDNSLFGAEKAKATEQMMRINEKKNEEIRNNLSDDYSAINFLKYKLAEMQDWTCIYSGRKIEITDFDACEIDHIFPRTDDTNDALYNKVICYKEEIADKHGRTPYEWMNNNTARWQEYIMRVKSLSQKSGKTKTALLTLSPTQSEKFLEKRKALNETTQIAKIVQSVTASVLEWDLQVKDKNRHIFISDGSSTHKIRQQYKLDRLLDDNAKKNRENGKHRALDAICISYSKDFQYNTEQHKYEIENIDIPHIEDVINHVVPYPYTNDKPLKSALAPAGTIYGKKVKNGKTYITKRIALLDIKKDSKSINKISDNDIKSDLLNKSGKNLSDDNWVKILSKYTHPKRGTKVKKVIVLEEFKGQITFDSNGRERLGEYCDFGNKGTKGQFKHSKQHRGQILYFNEKGKIKVMPVYANKKVQDVKDELINMGCKLYHGGEMFYSGCLIEIPNDFKAGGNIQPKGIYKVSTITTAGLVKIENNSGNIVHTNSTHITEADFRKFIKRSNS

SEQ ID NO: 47 - protein, 1015 aa, unidentified; identical to SEQ ID NO: 46
  REGION 1..1015: note = Description of Unknown:uncultivated organism
  REGION 1..1015: note = MG1-50 effector

SEQ ID NO: 48 - protein, 997 aa, unidentified
  REGION 1..997: note = Description of Unknown:uncultivated organism with predicted taxonomy: CandidatusMelainabacteria bacterium
  REGION 1..997: note = MG1-51 effector
MNKKVYAFDLGKASIGYCVREDFNILELGSLIINKDHAEVITNRDRRRVYKTILAHKKREEFFNNLWSECGLTLLSKTDKRFTIEFSSSNDNTIYNSTLLRIALLQNKPLEQWQIYKALHNAIQRRGYDAEIAWTNDSADEKDNQKRVIKYTQDDLGNELIKDENYKYPCYYDALRLQLWSEKNPKDFNRHIPLTGSTKVRTTGLVVPRAFVEKELTQLYLNAQKQLPQLKKYTVEYFLYGKYGSAYATFRTPQQGKEKDYGVLGQKIPRFDNRIIGKCKLLPKRNVCKANTIENVSFVLLMKLKNLRFTDINGNKCKLGLSAIKDIYNNWYKESGNGKKLNTTITKTKIEKVIGCKILEDAKNINETLKANTSGRSSFCRRACQIMNKIILEGIANPLTMDVVEFTDDVGTANGITEQEIREMLSKIGTWENLYIPDNRYEMVELSSDDRQKTDLLIGKITNPIVRNRLQILRDKLLALKEKYGTPDKVIFEFIRDGADNSLYGAQKANNYLISIKANEKENNEIKKELEDANAYSNTNFDKLKLLRMQGGRCIYSGEKIGISNFEQCDIDHIFPRSRGGNDALYNKVLCYSKENRIKGDKVPYEWLNNTENWDIYLQRTRDLKGSLGKKKFELLTSKPDQCEKLIESYNGLADTAQIAKVAQQLAAFIFGWGMQTDGDKRHLFVNNGSTTAAIRRRYGLNKILGNDIKKNRENDKHHALDAICISFSQDFKYDPKSQKDIINGFTYDFVKNEIDKLIPYPYANNKPFKGNTKPLETIYGYREYNGKKYITNKIDINSLEQKEKKIKNIIDEVIKNDLLNKINLPSDEWKNMLQNYIHPKKQTHVKKVMVIVSEGDVTFDTNNRIRMGEYVDFGTKNVKKQFKHSKGHKGQILYYNEKGAIKVMPVYANQKLQEVKEKLLGMNCKLYKKGMMFTSGCLLEIPNEFYAGSNKYPAGIYKLRTIIADTCVIKIESSEGIEIVSSAKYLADAEFKKYKP

SEQ ID NO: 49 - protein, 997 aa, unidentified
  REGION 1..997: note = Description of Unknown:uncultivated organism
  REGION 1..997: note = MG1-52 effector
MNKKVYAFDLGKASIGYCAREGFNILDLGSLIINKDHAEVVSNRDRRRVHKTLLAHRTREEFFNKLWKDCGLEILDKSDKRFTIEFAKNNDSILYNSILLRIALLQNKPLEEWQIYKSLHNAIQRRGYDANLVWANDSDDEKTNKELAARYMQDEAGIELITNDEYKYPCYYDATRLGLWNEEAPNKFNRHIPLTDVTKVRTTGLVAPRQLVEKELTQLYLNAQKQLPQLNKYSVEYFLYGKYGRAYATFRKPEHGREKDYGVLGQKIPRFDNRIISKCKLLPKRNVCKAATLENVSFTLLMKLKNLRFTAPDGNKHMLSADAIREIYENWLQESNNGEKLNTTITKTKIEKVIGFKMLDDTKNINETLKANINGRSSFCRRACQIMNKIILEGIENPATMDVAEFTDDITAHNGITEAEIREMLSKIGTWDNLYIPDNRYEMAELSSDDRQKTDLIIGKITNPIVRNRLQILRDKLLELKSEYGTPDEVIFEFIRDGADNSLYGAKKSNDYLKNIKENEKENLEIKKELEDVDRYSPTNFEKLKLLRMQGGKCIYSGKPICIDDFDKCEIDHIYPRTMGGNDALYNRVLCYSIENQNKKGRTPYEWLSNDKEYWSAYVDRLNKIKGSLGKKKFELLTSKPEDCEKLIESYNGLAETAQIARVAQQLAAFIFGLGMQTEGDKRHLFVNNGSTTAAIRRRYGLNKLLGDDVKKNRENDKHHALDAICISFSRDFKYDEKSKKDVIEGFTYDFVKKAIDELIPYPYANDKQFKGNIRPLETIYGYREYGNKKYITNRVDITTIEQKEKKIKTIVDEYIKKDLLDKLNLSSSEWVELMKNYKHPKKHTIVKKVLTLVSEGEISKDSNDKSRMGEYADFGTKGVANQFKHSKGHKGQILYYNEKGAIKVMPIYANQKLSDVKQKLMSMGCKLYKKGMMFTAGCLLNIPNDFYVSENLYTSGIYKLRTIMSSGQIKIENSNGKEIITSAKYLTDANFLKYKN

SEQ ID NO: 50 - protein, 1015 aa, unidentified; identical to SEQ ID NO: 46
  REGION 1..1015: note = Description of Unknown:uncultivated organism
  REGION 1..1015: note = MG1-53 effector

SEQ ID NO: 51 - protein, 1015 aa, unidentified; identical to SEQ ID NO: 46
  REGION 1..1015: note = Description of Unknown:uncultivated organism
  REGION 1..1015: note = MG1-54 effector

SEQ ID NO: 52 - protein, 1015 aa, unidentified; identical to SEQ ID NO: 46
  REGION 1..1015: note = Description of Unknown:uncultivated organism
  REGION 1..1015: note = MG1-55 effector

SEQ ID NO: 53 - protein, 1003 aa, unidentified
  REGION 1..1003: note = Description of Unknown:uncultivated organism
  REGION 1..1003: note = MG1-56 effector
MTKKVFAFDMGKASIGFCVRDNHDIKEANSIIIDKDHSDISSLRDRRRVYRTLKAHHAREAFFNTLWTECGLSLLDKNDIRFTKEFSGKKDNTIYTSCLLRIALLQNKHLERWQIYKAIFNALQRRGYDPKLAWKTAQTDDDKENLELVEKYTQENGIELIQSEEYKYPCYYDATRLGLWSEEEPNKLKTCQPMNGIIKVRSTNYVAPRSMVEKELAQLWENAQIQLPQLKKYSTDYFLYGEYREAYGSYKNPDYRKFMGTEYDWQGALGQKIPRFNNRIIAKCKLLPKRNVCKAETLENVTFVLLMKLKNLRFTSPDGQKCMLSADAIKEIYNNWLMESDNGKKLNTTITKTKIEKVIGYKMLDNTKNINDTMKVNLSGRSSFCRRACQIMNRIILDGIEEPKTMDVAEFIDNIDTPNGITEQEIRTMLSKIGTWDNLYIPDNRNEMAEIADDSRTKTDIMIGNITNPIVRNRLQIFRDLLLRLKSDYGTPDEVIFEFVRDEADNSLEGQKRAKDTENYMKAQAKENEQIKKELEEQNALSGINFEKLKLLKMQGGKCIYSGQNIGISDFDKCEIDHIYPRTMGGNDALYNRVLCYRIENQDKKGRTPYEWLSHDEEQWAAYVHRLSEIKQILGKKKFELLTSKPEDCAKIIDSYNGLAETAHIARVAQQITAFIFDWGLQLEGENRHIFVNNGSSTCAIRKRYHLNSLLGDDEKKNRSNDKHHALDAICISYSRDFKYDKNIKKDTIEEFNPEVVKKVIDEIIPYPYANKKPFKGNTRPLETIYGLRYREKSYITNRVAITSIEQKDKKIKTIIDETIKNDLLNKLEEKMSSNDWINMLENYVHPKKRTHVKKVNVIVSEGKIEADKNGRDRIGEYSDFGTKGTQHQFKHSKGHKGQILYFNEKGAIKVMPVYANKSTKEVRKQLEQMGCKLYNGGELFYSGCLIEVPNEFKGTKSNQKHGIYKLRTMMSDGKVKLENNSGEEIMTSANYLVNAKFSKYKD

SEQ ID NO: 54 - protein, 1013 aa, unidentified
  REGION 1..1013: note = Description of Unknown:uncultivated organism
  REGION 1..1013: note = MG1-57 effector
MKKIFAFDMGKKGLGYCCREGSKINCAGSIIVEPDHSSIEDVRNRRRIIRTRNSHKSREKYFNKLWHVEAGLEILDNNDELFKTEFSKQNDETIYNSTLLRIALLQNRKLENWQIYKALHNAFQRRGYDSALPWKNSKTKDDEESEKQVKIYTQKDGKELIEKDEFQYPCYYDALSLGLWEEKNPYDLKRTISKEPQKIRTGGRVAPRNLVIKELSDLWIAAQKQIPKLQKISVEKFLYGDYREPYASYTNPDWRKNMGKKEDWQGVLGQKIPRFNNRVISKCKLLPKRNVCSADTIENIVFTLLYQLKNFRYTNSKGKVGCRLAPFDIKEIYDNNIEVWINNLEENKKNNKNHTFTVSKTEIEKVIGKGEIYTTKNEKFESFKANTSGRSSFCRRALQIMNEIILTGTEPQDIEVSKYVDKSTTNNPITEEEIREMLSKVGDWNELYIPDNRAEVAELAQNSDIQSDLMIGSITNPIVRNRLQIFKNLLIDMIRKYGKPEEVIFEFVRDGKDNSLFGAEKAKATEQMMKNNEKKNEEIKKNLGDDYSAINFLKYKLAEMQDWKCIYSGRKIGITDFAACEIDHIFPRTDDGNDALYNKVICYKEENADKLGRTPYEWLYHNIARWQEYVTRVKSLSQKLGKTKTALLTLPPEQSEKLLEKKNALNETAQIAKVAQSITAFILGWGLQVKGENRHIFVNNGSSTHKIRQQFKLNRLLGNDEKKNRENDKHHALDAICISYSKDFRYNTEKHKYEIDNLDIPHIEEVINSIVPYPYTNDKPLKSAVAPEETIYGKKIKDGKTYITKRISLADIKKDTKSINKISDEDIKKDLLLKSEQNLSERDWTNLLQDYIHPKRGTRVKKVITLEEFKGKITYDSNGRERLGEYCDFGNKGTKGQFKRSKQHRGQILYFDDKGKVKVMPVYSNKKVQDVKDELINMGCKLYRGGEMFNSGCQIEIPNDFKAGSNMYPKGLYKLSTITTAGQIKIENNSGNQLLTSATYLVQAEFKKSKKKR

SEQ ID NO: 55 - protein, 809 aa, unidentified
  REGION 1..809: note = Description of Unknown:uncultivated organism with predicted taxonomy: CandidatusTermititenax aidoneus
  REGION 1..809: note = MG1-58 effector
GEYEQAYGSYLNPDFKKYRGTNRDWQGVLGQKIPRFDNRIISKCKLLPKRNVCKSETIENVSFVLLMKLKNLRFTNLMGEKCILNSDAIKQIYENWKNKALKENGEYKLDTTITKKEIENVIGEKIQDKIEPMKANISGRSSFCRRACQIMNKIILEGIENPAEMDVIEFMDNIDSPNGITEKEIREMLSKIGNWDNLYIPDNRYKMAEISSDDREKTDLLIGNITNPIVRNRLQIFRDKLLKMKQEYGTPDEVIFEFVRDGADNSVLSGAKAEGYKLLCEQNYAKNEKLKNDLGDDFSPQNLIKLKLLESQNFQCIYSGNNIAPTDLDACEIDHIYPRTMGGNDALYNKVLCYSIENQNKKGRTPYEWFHQEKTEEEWIEYKNRCFNFLNKYPIPKKVKRRQDNHISKSIKEYYVKLSEYKLAKKKFELLTSKPEDCEKLIESYNGLAETAQIARVAQEITAFVFGWGMQTSGDDRHIFVNNGSSTSAIRRRYGLNKILGDDVKKNRENDKHHALDAICISFSRDFKYDEHSKKDVIKGFTYDFVKKEIDKLMPYPYANDKHFKGNTKPLETIYGYRRIDNKDYITKRISITDINKKEKVIKTILDKQIRKDLLDNLKLSDNEWKEYLSNYTHPTQKTIVKKVLTIESEGTLTFDKNNRGRIGEFADFGTKGTKYQFKHSKGHKGQILYYNEKGNIKVMPIYANQKKSDVIENLEQMNCKLYKNGMMFYSGCLIEISKEFIATVYYTIKDENDKNKQISQKETLNSGIYKLRTIKSDGTIKIENNNGIEILTSVKILSEINFKKYKKS

SEQ ID NO: 56 - protein, 1076 aa, unidentified
  REGION 1..1076: note = Description of Unknown:uncultivated organism with predicted taxonomy: Verrucomicrobia
  REGION 1..1076: note = MG1-59 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKIVVPVKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAFAETAWISKLAQRICCLHFGFQFGGLTGAKKVWTVSGNTTAMIRGRYGLNRLLHDEESAADSLFDRICMEKKFEEKNRKNKKHHALDAMCLCFAPTSNAKKASAYKNILPEEITRNPESDEARKFFGKYLANVIPNKVAVEKPTLEQTIYAKRLIGGKETIVKKCNVRELAYTGINPKYNYSTLVKSIKSIVAEVPKRIISDFVLSNPNLSESEWEDWCKYEALIPSKNGAPTKLLRVLCDVGSPEEYKDLSKDGCGAYRKGDSHKGQFIWKTKQGRYVVAPVYAHASKAKVFAALKNNPDCAEVCGFFRQNCLVEIPNDVVDKSGKMLLKAGVYRSNTIKTDCRAKLTNSDGISPNPISIQYLMPAGMKRIKLDTL

SEQ ID NO: 57 - protein, 956 aa, unidentified
  REGION 1..956: note = Description of Unknown:uncultivated organism with predicted taxonomy: unclassifiedVerrucomicrobia (miscellaneous)
  REGION 1..956: note = MG1-60 effector
EFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKEGGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 58 - protein, 1043 aa, unidentified
  REGION 1..1043: note = Description of Unknown:uncultivated organism
  REGION 1..1043: note = MG1-61 effector
MENKTVFAFDIGTGSLGTCVRKEKEILDLSVNLLPQDFASLKEAREKRRQIRTRIAHKMREKWWKEQAQKAGIEIPETGHLDEKGNFIKPDERMSREFPKEGDNTIYNSALLRIALLQGKKLEGWQIFKAIWSAIQHRGYDSNLPWINNPKRNVEEEGEENKDEKENKEAVKKYNNELKKVFGEGDENERFYYPCYYEAYKMGIWSKEEPENLNKKISNNPSPARNKDGKVDLVIPRELIEKEIKDMLIKAGDKYTYIKENLDYILYGPSKSKYAAYNLKEYKKYRGKDWEWQGLLSQKTPRFDNRLISKCVLIPRLNVCKAKDELNKEVTFLMKLNNMRYFEIKGGEEKKLNAEQIKQIFEKFKDKLKITKDQWSKYLKINFAAVPNPGQLKIDAPKISGRSSFCRPALGIIKELILSGKKPSELYKELTENNKNTDPKKGLIKEDYNFLLKLPDDYNFYISDSRDEESKLNESERKNKIDEIISEIINPVVKHRLKLFYDKLIELKQKHGTPEKIIIEFVRDPKEGFYGEKRRKEIIFEQNKKRKENDLAFEDAKKIGLKGKDAVLKIKLHKEQGGFDIYDGNPIKDNEIDNYEIDHIVPRESGGPDSYINKVLTSRKNNEEKGKRTPYEWLKDKNYWNDYVKRIKDSKTLNDKKKTLLTSSEAVNLAEKYTQLAETAYIAKMSQKIAHLFFGWSQGTLGSKKKVIVANGSLTAKMRGLYGLNRILHSGISEEEYKELVKSGKIDEKNRDNPRHHALDAIVLSMLPEIQMNDRKKDFFPIWFTPDYCRENLEKCFPKHIKYEKPKLAETIYGLRKVLDNGKERYVFVMRFGKGTKIEEYYDMDLAKKNLDSILSDKIKKDFSEKLSENPSAEEWKKFIDDYNAGGKVKKIILKCSSLIDPEEIKDFLEGKVRNYGEYIKGKMPGQYLKQKKDSYGYMVYKNEEGKWIRESIYAFDSVIKKQKEIKEKYKETYYFRSGMIVEIQETFEFDGRKEKIKVKKGKYYLKTIGFTNQVKIESIDSSSDFLINLKYLMENGKMKPVF

SEQ ID NO: 59 - protein, 1043 aa, unidentified; identical to SEQ ID NO: 58
  REGION 1..1043: note = Description of Unknown:uncultivated organism with predicted taxonomy:Deltaproteobacteria
  REGION 1..1043: note = MG1-62 effector

SEQ ID NO: 60 - protein, 833 aa, unidentified
  REGION 1..833: note = Description of Unknown:uncultivated organism with predicted taxonomy: Verrucomicrobiabacterium 61-8
  REGION 1..833: note = MG1-63 effector
DGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDNAPAEERPTGNGKALKGYRKQQRTWLLTGDLDFLDHVWKATDRDGNPRDFEPHQLRIPDMTLRDLRKRHDLTETPYSELLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLLEAQGPACIYTNKPIRCTDLPNLQIEHIVPRALGGPDAFWNWVLSDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRTKEDFFRFPTAIGDNDFYSKEDQPEMAAIKSELAKLYVENKPVFREIKQARLAGDFGRLQQLKASVFPARKRIAELYRALDKLKQPRNVRAVREWFRAQLEGASPAPNGPVLPRTMAWQRTPTEATLYRRVYLIYKDCP

SEQ ID NO: 61 - protein, 1306 aa, unidentified
  REGION 1..1306: note = Description of Unknown:uncultivated organism
  REGION 1..1306: note = MG1-64 effector
IGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNPLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSELLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAQLGRRKADLHLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSELAKLYVENKPVFREIKQARLAGDFGRLQQLKASVFPARKRIAELYRALDKLKQPRNVRAVREWFRSQLEGASPAAKRPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYAWNPDHLAETARNILRKDDAQARTRGRRRTPAPASSPSADASPWPGFLWDREMQAKLASPKFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 62 - protein, 1150 aa, unidentified
  REGION 1..1150: note = Description of Unknown:uncultivated organism with predicted taxonomy: Verrucomicrobia
  REGION 1..1150: note = MG1-65 effector
ILPSGKAKDGAPAATEADLAICYNSALLRIKLLRGEKLEEWQIFKALRAALQNRGQQIVPWIAREAARTGKTPEELLEEEKKALKDKDPDDQSPMTKWQEFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPRIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILFGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLAETAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 63 - protein, 1076 aa, unidentified
  REGION 1..1076: note = Description of Unknown:uncultivated organism
  REGION 1..1076: note = MG1-66 effector
MADERIFSFDLGTGSIAYCVREGSNVIALGVDEIPSDFSELKDVRERTRQIRTRKAHKVREEWWKKHAELAGIEVPETGHLDEETGKFIPPDIRISTEFTKPGDSTIYNSYLLRIALLQGKELESWQIFKAIWSAIQHRGYERVPWINKEEDNEDTNKKRKSKSEGSEKEKEEREIQQAVVNYRNELKNAFGEKTQYYYPCYLEAYRLGIWSPDEPDNLTKTISDNPEPIRNKGGKIRRIIPRELLEAEIKQLLHQAGKKYPYIEENLDVILYGPAKTKYPAYTLKEYRRFMGKDWEWQGLLSQKTPRFDNRIIYKCRLIPRLNACKRKDPLAQEVIFLMKLKNFRYVDAETGEVLALKPEQLKTMFEEFQEEKKIGKRELEKFVKIRLNGKPHPGHTVIEPPNTNGRASFCRPALRIIKEILLTGKSPHQLYEEYTKANTNTDPRKGLVNDDYKFLLDLPAEWDKFHIPDRREEEAGLDEETRLKKIQELLGKITNAVVRHRLVLFYQKLQELKEKYGSPDKVIFEFARDPEETLDSKGRKERYKKVQDANRKAKEEAKKNLRELRNNGISIDGENALLKVRLWQEQNGRDLYTGLPIGQTEISICEIDHIIPREMGGPNAMYNFVLTKPECNREKGKRTPYQWLGSDPEKWQMFVDRINSEEYKKLSDRKKELLLKTITDEDELKELVEKYTHLAETSYISRLAQKIVHLYFGWEQLTKGSSRRVFVVSGAFTKRIRDLFKLDAILYPDLTLEEVYKYSAEEREEKNRNNPRHHALDALVVSITQEIKYNPLKGKDEYPEWFTPEFCKQAVERCLPVKVRFEKPTLAETIYGLRPYLDDNGRPTGKYVFVTRFGEGTDFEEYDDLDHAKKNVDSIYSANIRRELKQKLDENPSEQEWKIFIYNYRAGGKPKKLLMIASSDFAQEEVEKFLRGEINNLGEFIKGKMPGQYLKQSKESRGYFVYKDAKGKWRREAIYAFESPYLKKRKILSELKGRGDVYFFRSGVLVEIRNDIIKKQKPQSGNTETISKGFYYLNTIFETGYSKITSMEGKECLLSISKLMEEGKMKPAQEIRMR

SEQ ID NO: 64 - protein, 1655 aa, unidentified
  REGION 1..1655: note = Description of Unknown:uncultivated organism
  REGION 1..1655: note = MG1-67 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPAFGEKTKDGAPSDAAGANLCYTSCLLRIKLLRWKPGDPLLEEWQVYKALRSAMQKRGYGRVPWAVKEARAQGKTPEELEAEEQKQLEQADPRYREAAGKWPKFKRAVPAEFHFPCYYDAFHMGLWSPDQPDQLRLRPDHRAASTRNVRFDRADVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAAFAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSELLRQNSAELERRDKAIVELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLLEAQGPACIYTNKPIRCTDLPNLQIEHIVPRSFGGPDAFWNWVLCDENANAEKGDRVPYVWFKEEKTDEEWADYKRRVLARAAQLGRRKVDLLLRPDAAELAGEKYTALAESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRNKEDFFRFPTAIGDNDLYSKEDQPKIEAIKSKLAKLYEENGAVFREIKQARLAGDFGRLQQLKASVFPARKRIAELYRALDKLKQPRNVRAVREWFRAQLEGASPAPNGPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYVWNPDHLAETARNILRKDDAQARTRGRRRTPAPASSPSADASPWPGFLWDREMQAKLASPEFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 65 - protein, 983 aa, unidentified
  REGION 1..983: note = Description of Unknown:uncultivated organism with predicted taxonomy: Elusimicrobiabacterium HGW-Elusimicrobia-1
  REGION 1..983: note = MG1-68 effector
MGKIYAFDLGTGSLGSCVREDKEIKDLSVELLPNDFATLKEARERRRQIRTRIAHKKREEWWKEQSQKAGIEVLETGHLDKNGNFIKPDDKISRQFPESGDDAIYNSSLLRIAILQGKKLEGWQIFKAIWSAIQHRGYDSNLPWIRESKRNIDEDENTEQINKDEKENQEAVKKYNNALKDVFGDKKEYYYPCYYEAYKMGIWSPNEPNNLNKKFSANPNPARNKDGKVDLVIPRDLIEKEIKDMLLKIGESYPYIKENLDLILYGPGKSKYAAYKAKEYRKYLGKDWEWQGLLSQKTPRFDNRLISKCALIPRLNVCKAKDELNKEVVFLMKLKDVRYYKIDGGEEKYLTNEEIKNIYEKFKDKLKITERQWTKYLKENLQGSPNPSQPKIEPSKPSGRSRFCRPALRIIKEIILSGKSPDLLYKELVENNKNTDPKKGLVKEDYSFLLKMPEKWENFHIPDNRMDESKLDETERKNLIEEIFSKTSNPIVKHRLKIFYDKLIEYKNKFGEPEKVIIEFVRDTDDGFYGKIKKKKIIAEQNKNRKESDLAFKEAQTLGLKGGESILKIKLYREQGGFDLYDGKTIKDTEIDNYEIDHIVPREDGGPDSYINKVLTSRKNNDDKGKRTPYEWLSKSDNWEEYFERVKKLPKDSKKKKDLLVSANAKELVEKYTQLAETAYIAKLSQKICHLFFGWEQGTEGSKRKVIVANGGLTAKMRNAYDLNRILHTGLSDAEYKELCKSGEIDKKNRDNPRHHALDAMVISMIPEIKMNDRKKDFFPIWFNPDYCREKLEQCFPKNIRYEKPKLAETIYGLREIIDDKGNKKYVFVSRLVGDVKNIEGYYDIKTAKKYLDKIFSDKIRKDFKEKLDSNPSNEEWKSFLDNYFAGGKPKKILLKVSDEYTYDKIKDFLDGKVKNCGEFIKGRLPGQYLKQKKEAYGYFIYKNEKEKWIRDVIYAFDSVFNKMKEIKSKYKEAYFFRSEMLV

SEQ ID NO: 66 - protein, 1235 aa, unidentified
  REGION 1..1235: note = Description of Unknown:uncultivated organism with predicted taxonomy: Pedosphaera sp.Tous-C6FEB
  REGION 1..1235: note = MG1-69 effector
RAMTSPATIWAFDLGKGSLGEAVLNLETHQFHHKATLLLPADLAQRGPASQAGTPASRYRALKVRQAHRERERWLDTVWQAAGLEVLQPRQTALVCALPPKRDDTGQPLFDQGHWALVGRADYRLEREFAPALGEKTKDGAPSDAAGANLCYTSCLLRIKLLRWKPGDPALEDWQVYKALRSAMQKRGYGPVPWAAEESRPKLTKEEQAKEQEIAARWDKFKKGYRYDENPDADPNRAPLPPQFHFPCYYDAFHMGLWRPDQPDHLRPRPDHRAASTRNVRFDRADVRKELIALGNNAAAMLPQLQQAFERWQSDGWTFRHPVTGEELTKPVRARTFGEFLCDGPAGQPDETSFEAFLNQRRQAGIRIGTFEEWMAALGQKTPRFDNRILAPCVLIPRYHACKVDARLEKDRAGRLTGKLVPDSLLASEVTFLLKLKNLLVADPVKGQRKLTVEEVREIFAFAQRRLKTLPLLTPEGEPAKEWPRKVANCFAINPSDWPKIAAEAECLKGLARLTVSDNGAPRPLTREEAEALLHAVAGGRRAAQTVLPAHLLPLVKRAAAAWKQAKQQAEEIMLRPLPGHEEVKAPRTCGRSAYSRVALRILKELILSGDAPSAFHARLVRREPDLLQRLGPAPGQPLAIFDDSTASNEAQRKQENAENRKHGLLVSELNFLLQMRKDDGSPDSWENLFIPAQTLEALQQRHTEDGRLDADAAVRELLGTIKDPVVRHRLGVFDERLRKLRFGDAREGLPGFGVPEAIVLEFVREDFMGEEAKRRLQTFQRQREEERKKARSIAAQAGAESALSALKCQLWEAQGGECLNGREVLDQTGQSKARCLYRQTALPLSRLDEYVIDHIVPRARGGPEAMVNYVLTTAETNEAKGDRTPFEWLHGSPDWDAYVARVKARAAALRNKKVQLLTREDAPELVERYTALAETAWISKLAQTIVNLRFGWRNGVDYSGPQPVKRVIVVSGGLTARVRRKYGLDKLLYGEDTAPEVLAKKVKNRDDDRHHALDAMVMTFIPHWARDPNKQGFFRFPPAFRDANGREDYQRIRSLFASHLQQIVPRHLAYEPSVLADTIYGGRLDNGRPVIVQRVPVRELAYKQEQQRPVFNLTYARDQIAHVRDPRLRRVLEAFVATGPDQAAWDNYCRALAAGTCPELPDRKVLKVTLNRDEDPEEFKDLSKDGCGAFRTRKGEHRGQFVYLDARGRVRVRPVRPFESLVAVKAEVERLAAG

SEQ ID NO: 67 - protein, 1052 aa, unidentified
  REGION 1..1052: note = Description of Unknown:uncultivated organism with predicted taxonomy: Endomicrobium
  REGION 1..1052: note = MG1-70 effector
SIAYCVREGVNVLDIGVDILPGDFASLKNVREKRRMIRTRMAHKVREEWWKMHAKEAGIEVLETGHLNENGEFVKPDIRLSTEFTPPGDSTIYNSYLLRIALLQGKDLESWQIFKAIWSAIQHRGYEKAPWVRKEEAQKEPSDGKKSRKSKSEDESEKEREEKEIQQAVENYRNELKQAFGDNHQYYYPCYLEAYKLGIWSPDEPDNLTKTISENPEPIRNKDGEIRRIIPRELLEKEIKELLQQAGKKYPYIEKNLNYILYGPAGTKYPAYTLKEYRRYMGKDWEWQGLLSQKTPRFDNRIISKCRLIPRLNVCRRKDELVQDVTFLMKLKNFRFIDRETGEVKALTPEQLKEMFETFRSERKINKTELKKYVKDRLNGWVHPSHTNIDPPKTTGRASYCRPALRILKEILLTGKSPHQLYQEYTSTNTNTDPRKGLVNDDYKFLLDLPAEWDNFYIPDRREEEANLDEETRLKKIYETFSKITNSVVRHRLLLFYNKLRELKEKYGAPDKVIFEFARDPEETLETSKRKDYKKIQKFNLKAKEKAKQILEELRSKGISMQGSNKVLKVRLWQEQGGFDVYTGQPIGETEIDICEIDHIVPREMGGPNARYNMVLTKPECNREKGKRTPYQWLGQDPEEWQKFVERLEREKGFENLPAKKKNLLVATNPEELIERYTHLAETSYISRLAQRIVHLFFGWEQLTKGSTRHVYVVSGALTKYIRDKFELDVLLYPDLTKEEVFKIPSEEREEKNRNNPRHHALDALVVSIARPENVDKYPEWFTQDFCRMAIEKCLPVKVRFEKPTLAETIYGLRPMLDDNGRPTGKYVFVTRFGEGTRFSDYSKLEHAKKNVDSIYSANIRRDLKNKLKENPSKEEWEVFIHNYRAGGKPKKLLMIASSEIDGDDVKKFLSGELRNLGEFIKGKMPGQFLKQAQESRGYFVYKDEKGKWRREVIYAFESPYLRRREILSKLKDCKEIYFFRSGMLVKIENDFLYEPRGGASKTIPGGYYYINTINVSEQVKITAIDGREIKLSLSQLMEKGRMKPAQKVRMD

SEQ ID NO: 68 - protein, 1110 aa, unidentified
  REGION 1..1110: note = Description of Unknown:uncultivated organism
  REGION 1..1110: note = MG1-71 effector
WQIYKALRAALQNRGQQTVPWIAREAARTGKTPEELLEEEKKAFENKDPDYQSALTKWQQFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPKIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILSGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLAETAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 69 - protein, 1005 aa, unidentified
  REGION 1..1005: note = Description of Unknown:uncultivated organism with predicted taxonomy:Deltaproteobacteria
  REGION 1..1005: note = MG1-72 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRILAPCVLIPRYHACKVDARLEKDRAGRLTGKLVPDSLLASEVTFLLKLKNLLVADPVKGQRKLTVQEVRDIFAFAQRRLKTLPLFTPEGEPAKEWPRKVANCFAINPSDWPKIAVETECLKGLARLTVSDNGAPRPLTREEAEALLHAVAGGRRAAQTALPAHLLPLVKRAAAAWKQAKQQAEEIMLRPLPGHEEVKAPRTSGRSAYSRVALRILKELILSGDAPSAFHARLVRRDPDLLQRLGPAPGQPLAIFDDSTASNEAQRKQHDAENRKRGLLVSELNFLLQMRKDDGSPDSWENLFIPAQTLEALQQRHTEDGRLDADAAVRELLGTIKDPVVRHRLGVFDERLRKLRFGDAREGLPGFGVPEAIVLEFVREDFMGEQAKRELQTFQKRREQARAEAEAEAAKLGLESRSSSLRYELFKAQGGICLYTGRTLSETQLDQYEIDHIVPRSLGGPDAMVNYVLTFPEVNSAKEKGKLTPYALLHGTDGWDAYVARVKARAAALRNKKVQLLTREDAPQLVERYTALAETAWISKLAQTIVNLRFGWRNGVDYSGPQPVKRVIVVSGGLTARVRAKYGLDKLLYGENTPPEVLAKKVKNRDDDRHHALDAMVMTFIPHWARDPHKEGFFRFP

SEQ ID NO: 70 - protein, 1141 aa, unidentified
  REGION 1..1141: note = Description of Unknown:uncultivated organism with predicted taxonomy: Pedosphaera sp.Tous-C6FEB
  REGION 1..1141: note = MG1-73 effector
SLTTLVTFPIVSPMPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFARWQRDGWTFRHPVTREALTKPVRARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSDLLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSQLAKLYVENKPVFREIKQARLAGDFGRLQQLKASVFPARKRIAELYRALDKLKQPRNVRAVREWFRAQLEGASPAPNGP

SEQ ID NO: 71 - protein, 1171 aa, unidentified
  REGION 1..1171: note = Description of Unknown:uncultivated organism
  REGION 1..1171: note = MG1-74 effector
WIPKLCQKADYRLEREFPPSRILPSGKAKDGAPAATEADLAICYNSALLRIKLLRGEKLEEWQIFKALRAALQNRGQQIVPWIAREAARTGKTPEELLEEEKKALKDKDPDDQSPMTKWQEFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPRIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILSGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLADTAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 72 - protein, 800 aa, unidentified
  REGION 1..800: note = Description of Unknown:uncultivated organism
  REGION 1..800: note = MG1-75 effector
MTESDPFQHKAILRKWENHEFYRSSVVLGLDVGLEGIGVYLRKGPRTLYEKTLLYQIPKTNALQDRRQSRAARRCRKNRRTRMTRLKALFERHGFPWFEGNDDALTRSDPFLLRHRATTKKLASREALGICIRHLVTHRRYEFFSDEGENPWGEEASLATEVKWLRTAYVDEKDADLLRTECRVLADVAGGRAEDKYEEFRQILEDRIVTERNNPILEMLESYAGEKRNHLRQKARGAVFPRRLVWSHLESICRRHGELFDDVDEFLRDLGAPRSRKDRAIFNYHRKTEEEMKAHWARKVGPCPYAEMLGLSSKLRRGVRGEMPIRRFSLLEFLVSRRIELSDGRLLLVPDSCIEMLFDWMERFEAAYRDQRTLPPMKKIREIVVGEMRKSTGQAPAPASKSEINKAFFEQIKGIMAPTASRRNARASLSCEAAEKLFEEATSSGLSRDSVNRQLQTYYQWRKRASSDFGLYPQVEFLLGRRRRRRAGEGEYAVSGRLQRIFSLPEVVEHLDGQASPDYCVIEVVGDIPRNEKERREKEQEIRKNQGRKEKLFERFNAADSAVGSAYKRVLLFDQQRGLCPYSGGELGDPLSSDLEIDHIFPRKRGGISVRENLVLTFADRNRDKGNLTPREAARKRNGWDWDEIEAATARMKWSRKKREIFEREGAGIPPLANVTRTAQLARQLVAECAHWMGIAGDPDEIQRRIGTPSGYMRAQALRSWEDTVPAKNRSDLVHHLVDAAVVAHIPPGAGMNQVSYGGIFYPSSVDGKDRARLAALPLGPGLRRWTAAEPLECSAAPPG

SEQ ID NO: 73 - protein, 953 aa, unidentified
  REGION 1..953: note = Description of Unknown:uncultivated organism
  REGION 1..953: note = MG1-76 effector
MGNGTIFSFDLGTGSIATCVRQDEEIKYIHVETLPGEFATLKETRERRRQIRTRLAHKQREEWWKIHAKEAGIEVLETGHLDEKGNFISPDPRLTCEFSKKGNPTIYNSLLLRIALLQGKKLEGWQIFKAIWNAIQRRGYDENIPWKHKLEAEKTEDDNEQENSKQTKGKKSKKKEDANSEDEEQKIRQAVIKYKEKLNNTFGDKEEYKYPSYLEAYLLGIWSPDEPDNLTKTISENPEPIRNKDGNIKLITPTELVEKELKQLLVKVGEQNEYIKKNLNYILYGPSGCRYGTYILPKYRRYIGKDREWEGLLSQKTPRFDNRIVYKCRLMPRFNVCKRKDLLSQEVIFLMKLKNFRFVDAETGEEKMLTPEQIQKMFNDFQNTLKINNRELKKYLKENFKGEIHPSFPAIDAPNTKGRASFCRPTLKIIKEIILSGKSPHTLYQEYTSSNTNTDPKKGLINNDYKFLLKMPTEWENFHIPDEREDEAQLNEDERIKVIYNILSKITNPVVRHRLLLFYRKLQYLKQEFGIPNIVMLEFARDPEELLAGEERKKKYLKLQKENRQKKEKAEKIYQELKNGNVNLKGRSILLKIQLWQEQNGIDPYSGEQIPQTKINLYEIDHIVPREMGGSDAYFNKVLTSPEKNREKAKRTPYQMFKGNISDWKKYLNTIEKITNLSKKKRALLTSENPEELIERYTHLAETAYISRLAQKICHLFFGWEQLTKGSQRKVFVVSGAFTRKIRTIFELDRILYPDLSDEEYKELLTKGEIQKKNRDNPRHHVLDTIVLSIIPEIKYNPEREKDDYPVWFNKEYCRQYIEKCFPRPIRFVKAKLAETIYGLRERNDYTEEEKKKGKKQYVFVTRFGTGTTLKELKEYDDLKFAKKNVESIYSYNIRQDLMKKLEEKPAPEEWKVFLHNYRAGGKPKKILVKASSYIDEEEVQKFLNGEIPNLGE

SEQ ID NO: 74 - protein, 898 aa, unidentified
  REGION 1..898: note = Description of Unknown:uncultivated organism
  REGION 1..898: note = MG1-77 effector
MTTPATIWAFDLGKGSLGEAVRDQQTNQFLHKATLLLPADLAQRGPATQAGTPASRYRALKVRQAHRERERWLDTVWQAAGLEVLQPRQTALVCELPPKRDDTGQPLFDQGHWALVGRADYRLEREFAPALGEKTRDGAPSDAAGANLCYTSCLLRIKLLRWKPGDPPLEEWQVYKALRSALQKRGYGRVPWAVKEARARGKTPEELEAEEQKQLEQADPRYREAAGKWPEFKRAVPVEFHFPCYYDAFHMGLWSPDQPDHLRLRPDHRAASTRNVRFDRADVRKELIALGNHAAAMLPQLQQAFERWQRDGWKFPHPVTGQELTKPVRARSFGEFLCDGPAGQPDETSFEAFLNQRREAGIRIGTFEEWMAALGQKTPKFDNRILAPCVLIPRYHACKVDARLEKDRAGRLTGRLVSDSLLASEVTLLLKLKNLLVADADTGQRKLTVEEVRDIFAFVQRRLKLLPLLTPEGEPVKEWPRKVADCFAINPSDWPKLAAETECLKGLARLTVSDNGAPRPLTREETEVLLHAVAGGRRAAQTALPAHLLPLVKKAEAAWKQAKQAVEGNILRPLPGHEEVKAPRTSGRSAYSRVALRILKELILSGDAPSAFHARLVQREPDLLQRLGPAPDQPLAIFDDSTASNETQRKQEDAENRKRGLLVSELNFLLQMRKDDGSPDSWENLFIPAQTIEALQQRHTEDGWLDADAAVRELLGTIKDPVVRHRLGVFDERLRKLRFGDARERLSGFGVPEAIVLEFVREDFMGEQAKRDLQSFQKRREQARAEAEAEAAKLGLGSRSRALRYELFKAQGGICLYTGRPLSETQLDQYEIDHIVPRSLGGPDAMVNYVLTFPEVNSAKEKGKLTPYALLHGTPHWDAYVARVKARAATLRNKKVQL

SEQ ID NO: 75 - protein, 1035 aa, unidentified
  REGION 1..1035: note = Description of Unknown:uncultivated organism with predicted taxonomy: Verrucomicrobia
  REGION 1..1035: note = MG1-78 effector
MSKTETVWAFDLGKGSMGEAVRQGNQFLHKASLLIPAEFAETRTARDRRRMWRTRQAHKARERWLDEVMTAAGIEVLKGRQVGKVDGKWVETAKGDPRLEREFAAPGDSTCYTSCLLRIKLLRGEKLEPWQIYKALHSAIQRRGYDPDIPWKTREQRQGKKSEDEEGKTLTRMQEFEKQLLAMSPDHPEYRWPCYFDAWKMGLWSPAKPDELKERLDFNAQTTRDQIVPRKVVEAEVRALVEAASQFYPSLKGKADYLLYGPPQRAYASYYVEQRKQHGLREGGVNDWQGVVGQKIPRFDNRIIGKCVLIPRLNVCKIRKGDDGKLHPQSRIVAETVFLMKLKNMRLQTAKGVTGLTAQQISKIFADPKRKKYGLTKTQWKQWCIKFGGMPLPGNQEEVEEPHFGGRSRFCRPALEIVKRLILSGDTPPMAYEKEVARLNGNTDPLKGLVKDDLKFLLQMGPTWEGIYIPNQKLDALTRSTEDANEAIRQLIGAQNDPIVRHRLTLFADRLNLLAEKHGTPDCVVLEFVREDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRTPYEWLSQTPGWDAYVERVKERAVTLRNKKVSLLTRPDADTLVDKYTALAETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEKPALAETIYGARNDHGAKVIVQRTALLSLAMKPTTPGKTTFDLKYAGKQAQSVRDPIIQKRLLEFIATNPDEATWRKFCAELHIKRKDGTAGPRVEYVTVTVGEPTEYKDMSKDGTGAYRKALKGHKGQFVFVDSKGKFKVRPVYAFESAQKVGQELTQKFGQNAIKGFFQSGCLVELTAPVPHSFTPLVPGQYKLNTIFTDGRAKLTDSTGKQSLPISLEKLFSAGFKRAR

SEQ ID NO: 76 - protein, 1333 aa, unidentified
  REGION 1..1333: note = Description of Unknown:uncultivated organism
  REGION 1..1333: note = MG1-79 effector
MPTTNPYVITHVTKNWMKDEFYDSALVLGLDIGIEGIGVWLRKGREPLFARTFMVSLPEAAPLKNRRAKRAQRHARQSLRRREAMLREWVVRYGLLPQEKTDGRWWKNPAVFERAFEHRHRAITTGVASPECLVVCIRHLLRHRGFDYHLTDEGAFPWGDELDDKEIIQWAKNSCCAPEYRTHLCNLIEADAAWAKNSDGSFTEKYLKVRQALDDAVREYENRPVERMLEQHMSEKNHPHLRPRARGRNFARELVKQHLYAICEKHRHFFAPGTFDQAMRELLGDQTGPSQWKLTWMDQDGKARQTILDYHRRTREEAEELWKRKVKKCPFAPLLFEKRHPTTPQHDCAVRSDPRIRRFNLLMFLAERRIELETHDAEGRLQNPRVNLDANVVRDLLGDLEQDIRAVEALRNKQSASRPDKPGKKTFEQRWRICNDCGKETGQDETGKSSCCKAKTKPKMPLAGVAKGSFNADFFDQLGDLLRPELRSLKGRASLSGEAAEVLFKLVTRNGTDFEPARIRQALEDCGYYDWRTNLPAGLGIYPQVTFLLGNRGHYDKDGNPRQIDKTTGNPVHHGILRRLFAGQLRLDDGTLVGLKDKLDDKVVPDYVVIETIGEIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMAQLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRKSKKSRYKETIFSLPDQQNRVFAREPLSKVVTSLLKSKKKNPDAELRKLLDRPGLLNPLEITNKKTGQTKQIKLLNKADVERWLSCKDVSLDQEGFRKFIEDVGVPTEQIPDDAVKAAFMKRNGETLLRKTFKPNSLVSFIRQKCRIKDSEIEARVEIAIAERNERTVLRAANGRDGQPGQVIRSILIEQDKLPPCGFGLHFNPTAKPKRGSEVAGFKPVDNSNSVVYLRREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNCTIEFQMAEFAEPKLVKGQIPDPATERLLETYELTCSNEADLLWLLEVTTGKRIKLPPPVVENAPTTGKREGELL

SEQ ID NO: 77 - protein, 1035 aa, unidentified
  REGION 1..1035: note = Description of Unknown:uncultivated organism with predicted taxonomy: Verrucomicrobia
  REGION 1..1035: note = MG1-80 effector
MSKTETVWAFDLGKGSMGEAVRQGNQFLHKASLLIPAEFAETRTARDRRRMWRTRQAHKARERWLDEVMTAAGIEVLKGRQVGKVDGKWVETAKGDPRLEREFAAPGDSTCYTSCLLRIKLLRGEKLEPWQIYKALHSAIQRRGYDPDIPWKTREQRQGKKSEDEEGKTLTRMQEFEKQLLAMSPDHPEYRWPCYFDAWKMGLWSPAKPDELKERLDFNAQTTRDQIVPRKVVEAEVRALVEAASQFYPSLKGKADYLLYGPPQRAYASYYVEQRKQHGLREGGVNDWQGVVGQKIPRFDNRIIGKCVLIPRLNVCKIRKGDDGKLHPQSRIVAETVFLMKLKNMRLQTAKGVTGLTAQQISKIFADPKRKKYGLTKTQWKQWCIKFGGMPLPGNQEEVEEPHFGGRSRFCRPALEIVKRLILSGDTPPMAYEKEVARLNGNTDPLKGLVKDDLKFLLQMGPTWEGIYIPNQKLDALTRSTEDANEAIRQLIGAQNDPIVRHRLTLFADRLNLLAEKHGTPDCVVLEFVREDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRMPYEWLSQTPGWDAYVERVKERAVTLRNKKVSLLTRPDADTLVDKYTALAETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEKPALAETIYGARNDHGAKVIVQRTALLSLAMKPTTPGKTTFDLKYAGKQAQSVRDPIIQKRLLEFIATNPDEATWRKFCAELHIKRKDGTAGPRVEYVTVTVGEPTEYKDMSKDGTGAYRKALKGHKGQFVFVDSKGKFKVRPVYAFESAQKVGQELTQKFGQNAIKGFFQSGCLVELTAPVPHSFTPLVPGQYKLNTIFTDGRAKLTDSTGKQSLPISLEKLFSAGFKRAR

SEQ ID NO: 78 - protein, 1074 aa, unidentified
  REGION 1..1074: note = Description of Unknown:uncultivated organism
  REGION 1..1074: note = MG1-81 effector
MNSSRSPVTRFSTGLVFGFDVGTGSIGWAVRNGTEFLDVGVLVCPEETAKLDSRRGLRRQRRTLRSKKYRRQWFARELAGLLGLTLIRQGQSELPLPETAWEQNAKGGWVPKPGFESLRDPVALRVAAAEGEPLRPEELFTALVHLFRLRGYLADVPWANREVEAKESDAKKEEGEIRARMSALQAEMQAAGCELPCQLLALRANNGQRQRKEVWPRELVEKEFRAIVAAQATRHPTLAEKADWLLFGDCREVKSHRVFFKTTESRNPGVLGLKWPRFDNRGPALDALRPIDELGRPLHVVRKNKEAFSKAQWELAVMNFRVIDRQTGALVPPDARALARLREMWESSSRKRRAKKEAMSGTPAGSPETTPRVEIKVALLEKWAAEFANRYKLVEGQQSLTPQTGAGRARYSTPTLELIREQFERGIRFDPPQPVLRRPGESPQRALDRYLADIKHPLVRHRLLLFSRLLDKLVKQHGEPDLIVLEAVRSLALGEKNKRELLKRNKANRDQRESIRQELASRNASTSRNAILRYRLWKEALSTCPFCGDKITQEQLLRGEADIEHLVPRSVVDCNEFYNLTVGHVRCNRELKGDRTPFQAFGHTEKWPQLRDNAEKCFKGRKLEIFLSDNAEQLIEQKADLQHTAYIARIVRHVALIRLGWTGDDGRDPTIIKGNKPSSSFQVTNGQLTSRLRQAWGLNHILHPLPEGKRWDDLTDAEKEQMQQKNRGDLRHHALDAMVIACTLPWLAHRTVGATDPETGEHGWWQLDERTRRSLALNPVFPTEGQMRRVAEEWMQKVVVRHHVSRSPHQSAYATTIYGKKAPNTYVAREVFTTLTPKNLGSIWPPDFAAYCEAAWARYVEESPDIEAELKRSKGCVPESFTARLCFAHFQQWRELMKRGENVEFTWPETVKIPIRSVRLISVKDDTAVMRFAPGTPGYVKRTGFKEVRIHVSADGNSFVPVFVPYWKGDAIPPETPIKTGTRPVAVIRKGQVVGLKKPLAAGASAGHYRVIVLGQSQVSILPPHVANKDEAKLALGIPRTGIKPYWPEFIRALGYELPHPPSAQSPPPGALPT

SEQ ID NO: 79 - protein, 917 aa, unidentified
  REGION 1..917: note = Description of Unknown:uncultivated organism
  REGION 1..917: note = MG1-82 effector
MTPATTIWAFDLGKGSLGEAVRDLQTDQFLHTTTLLLPADLAQRGPARQAGTPASRYRAWKVRHAHRERERWLATVWRATGLTPLQTREVWQNPSTGRWELKHPADYRLEREFAPTLGEKTRDGAPSDEAGANLCYTSCLLRIKLLRWKPGDPPLEKWQVYKALRSAMQKRGYGRVPWAVKEARARGKTPEELEAEEQKQLEQADPRYREAAGKWPDFKRAVPAEFHFPCYYDALYMGLWSPDQPGHLRLRPDHRAASTRNVRFDRADVRKELIALGNNAAAMLPQLQQAFERWQHDGWKFLHPVTGQEVTYPVRARTFGEFLCDGPAGQPDETSFEAFLNQRREGGIRIGTFEEWMAALGQKTPKFDNRILAPCVLIPRYHACKVDARLEKDRAGRLTGKLVPDSLLASEVTLLLKLKNLLVADADKGQRKLTVEEIRDIFAFAQRRLRTLPLLNPKGEPVKEWPKKVANCFAITPSDWPKLAAETECLKGLARLTVSDNGTSRPLTSEEAEALLHAVAGGRRAAQTALPAHLLPLLKRAADTWRQAKQAAEGNVLRPLPGHEEVNAPRTSGRSAYSRVALRILKELILSGDAPSAFHARLVRREPVLLQRLGPAPDKPLAIFDDSTASNEAQRKQADAENRKRGLLVSELSFLRQMRKDDGSPDSWENLFIPAQTLEALQQRHTENGRLDADAAVRELLGTIKDPVVRHRLGVFDERLRKLRFGDAREGLPGFGVPEAIVLEFVREDFMGEEAKRRLRSFQRQREAERKRAREETAEAGATEKSAPLKYELLTAQGGLCLYCGQALTLKKLEQYAIDHIVPVGAQGSDALFNKVLAHQECNAAKGKQTPFEWLHGTPGWDAYVARVKARAATLRNKKVQLLTREDAPELVERYTALAETAWISKLAQTIVNLRFG

SEQ ID NO: 80 - protein, 1016 aa, unidentified
  REGION 1..1016: note = Description of Unknown:uncultivated organism
  REGION 1..1016: note = MG1-83 effector
DSAGKPQQTILDYHRKTPEEAKELWERKVKDCPFAPTLHQQDKLSTPKHKCSFRSDARIRRFNLLMFLAERRVELETEDAQGQRQNPCVNLDAEVVRQLMEDLEKDIHAVEALVNKQPAPRPDKPGKKNFEKRFNLSLAGVAKGSFNADFFDQLGDLLRPELRSLRQRASLSGEAAEVLYQLATNNGTTFEPVKVRQALEECDYYHWRANPPHGLGIYPQVAFLLGQRGHYDDEGNPTDKDKAGNPVHHGILRRLFAGQLRLDDGTGQGAKLIDLCEHLDGKTVPDYVIIETIGDIPRNQKEKKEFKDEIKANRSRKTDIIEKKYNLKLDSLSDWQVKQVLLFDQQANDDGEAFSPYTGASLGKNPLAHGLEVEHIYPERRGGISIMDNLVITWRTENQTKGDQTPWEWLGQRATAQLQKMHWNRDKRALFVREESEPPQWDNTTRMAQIARYLRVEIIHWLGLDRIKNEMERNKQIAGRIGTPTGFQTSICRESWTPRTVFPQMYRLLHDKKGIPVRDQHGRERWVKDRTNLRHHLWDAAVLSHIPPREGLNSADCGGIFVHRRDQQTGEWRVSALPNLGPDLVAFEKENEGRCLVAHLRQRKSKRSRYKDTIFGLPDREQKHFAREPLDKVVAGLLKSKKKNPDVQLRKLLDRPGFLKPLEIKNKKTGEMKRIQLLREEDLTRWLSCKDISLDPQEFRDFIAKLGVPAECVTDEAVAEQFLNSKTGESRPKWNFKPTQIIAFIRKCGVKEDKLPNSRVEDAIRARKECTVLRASNGRDGQQGQAIRRIPIEQDKLPPCGFGLHFNPTAEAKHGNAIAGFKAVDNSNSIVYLRREIWIGQKWKKKGKDKVASTFYESRLIPHPRHLAAYEKLHGQPWKSEPLPAGMSLAGCLAVGDLLRVPLKKEKKNAGDNLIAKRGEPPVEWKFYRVKSLRTEGPVEFQLAEFTEPKLAKDQIPDAATKRLLDICELSSRKDADLLWLLEATTGQEVQPLPPCDEPPPVSPTKPATKTGDELL

SEQ ID NO: 81 - protein, 1062 aa, unidentified
  REGION 1..1062: note = Description of Unknown:uncultivated organism with predicted taxonomy:Coraliomargarita sp. CAG:312
  REGION 1..1062: note = MG1-84 effector
MNNNNTQIWGFDIGKASLGEAVWCGGEFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 82 - protein, 1080 aa, unidentified
  REGION 1..1080: note = Description of Unknown:uncultivated organism with predicted taxonomy: unclassifiedVerrucomicrobia (miscellaneous)
  REGION 1..1080: note = MG1-85 effector
YIVDFCSHCKYFNNNKKFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 83 - protein, 1062 aa, unidentified
  REGION 1..1062: note = Description of Unknown:uncultivated organism with predicted taxonomy:Coraliomargarita sp. CAG:312
  REGION 1..1062: note = MG1-86 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLQFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDMETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPVLEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 84 - protein, 1073 aa, unidentified
  REGION 1..1073: note = Description of Unknown:uncultivated organism with predicted taxonomy: Verrucomicrobia
  REGION 1..1073: note = MG1-87 effector
MYTKEIIWGFDIGKGSLGEAVRVGNEFKHVQSLEIAPDFAETKTTAAARRAWRTREAHKAREFWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELVKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKKSALEQTIYALRKGRIVKKCNVRDLAYTGINPKYNYSTLVKSIKSIVGEVPKRIVSDFVLSNSDLSESEWEDWCKNNAAIPSKNGAPTKLLRVLCDAGNPEEYKDLSKDGCGAYRKGDSHKGQFIWKTKQGRYVVAPVYAHASKAKVLASLKNNPDCAEVCGFFRQNCLVEIPNDVVDKSGKMLLKSGIYKSNSIRADGYGYLENSDGISSKPISIQYLMPAGMKRIKLDII

SEQ ID NO: 85 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-88 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 86 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-89 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCCNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 87 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-90 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGIFNSHCTVDVGDVYNDKGDFILPAGRYMVNTIRSDNQCVLTNADGEKRNPININYLMRAGMRRVDLSEL

SEQ ID NO: 88 - protein, 874 aa, unidentified
  REGION 1..874: note = Description of Unknown:uncultivated organism
  REGION 1..874: note = MG1-91 effector
MVKRVARLRQTFWRDTENPDVVKIRIDNTAEKAKGYVVPRSAVIAEFRALVDAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLINGKETIVKKCNVRDLAYAGRNPQYSYLTLVKNIKCIVGKVSKNIISDFVLSNPDLNESEWENWCKYDAVIPSKNGAPTKLLRVLCGARNPEEYKDLSKDGCGAYRKGNLHKGQFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 89 - protein, 1077 aa, unidentified
  REGION 1..1077: note = Description of Unknown:uncultivated organism with predicted taxonomy: unclassifiedVerrucomicrobia (miscellaneous)
  REGION 1..1077: note = MG1-92 effector
MSLYFIEQISDWKIMKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 90 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-93 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGREISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 91 - protein, 762 aa, unidentified
  REGION 1..762: note = Description of Unknown:uncultivated organism with predicted taxonomy: unclassifiedVerrucomicrobia (miscellaneous)
  REGION 1..762: note = MG1-94 effector
NRIIGKCKLIPRLNVCKIKPLKECKTEDDFLPHTITLALKLLNLRFFRGAGIDSLSFDEFLRAFEIARQNKFALNKTNLKKFFKTIGAEIMDENQSSVEQPREGGRASYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDRTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLEEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLVEIGNPEEYKDLSKDGCGAYRKGDSHKGQFIWKNKKGRYIVAPIYAHASKAKVLDDLQNNPDCAEICGFFRTNCLVKIPNDVADKDGKFLLKAGFYKSNTIMASGSVKLTDPNGIIKIVGIQHLMNAGMKRVETNTI

SEQ ID NO: 92 - protein, 1062 aa, unidentified
  REGION 1..1062: note = Description of Unknown:uncultivated organism with predicted taxonomy:Coraliomargarita sp. CAG:312
  REGION 1..1062: note = MG1-95 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARATELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 93 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-96 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANVAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 94 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-97 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGIVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 95 - protein, 1059 aa, unidentified; identical to SEQ ID NO: 86
  REGION 1..1059: note = Description of Unknown:uncultivated organism with predicted taxonomy: unclassifiedVerrucomicrobia (miscellaneous)
  REGION 1..1059: note = MG1-98 effector

SEQ ID NO: 96 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-99 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPELKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 97 - protein, 1062 aa, unidentified
  REGION 1..1062: note = Description of Unknown:uncultivated organism with predicted taxonomy:Coraliomargarita sp. CAG:312
  REGION 1..1062: note = MG1-100 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINSTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRVSIKYK

SEQ ID NO: 98 - protein, 1055 aa, unidentified
  REGION 1..1055: note = Description of Unknown:uncultivated organism with predicted taxonomy: unclassifiedVerrucomicrobia (miscellaneous)
  REGION 1..1055: note = MG1-101 effector
MENRVNIWGFDIGKGSLGEAVRIGSEIKHVQSLILYKDFGEIKTAAGIRRQYRTRKAHRAREKFLEKVLGECGIEVLRRREVGIVDGCWKLIAKGDIRLEKEFPSPGEDVCYNSIALRCKLLLGEPLESWQVFKALNSAIQNRGYDPDIPWTETDADKKEDSDWAKRLSAYEDEKKVVFSGLADPQRYDYPCFFKAYKMGLWSPEDPEIVKLRIDNHAEKAKNYVIPRKCVEAEFEKLVENASLQYPKLKGKALYIMFGPAQKEYASLNPELRRQFNLKRGADTDWTALGQKIPRFDNRIVDKCKLMPRFNVCKIRSLDEIKNPADFLPYEITTLMKLLNLRFLRNGTIESLACDELKEAFELARDNKYKLSKTALKKFLKKIGAEVLDEDQSKIEAPRSGGRASFSRPAMAVLKELILSGESPAKFYARKVSQIENTDKLKGLVASDFDFIKQMGDIAWGKIFMPDMRLLEFANRQNIDAEARINKLIGSQNDPIVRHRLGFFYDRIKFLESKFGVPDKIVIEFVRDDFLGEKAKKEYQKAINERFKEKQELAKEMDEAGYKGAKMLLKLELYKKQGGQCVYTGEALPSSEIASLEIEHIVPRSRGGPDSIYNYVLTRESTNKEKADMTPYEWLSRNADRWNAYVSRVNSLYKSLGGKRCKLLLANNAEELVDKYTALAETAWISKLAQQVVCLHFGFQFGGMEGQRRVFCIPGGVTARIRGMFGLNELLHVKDYDTDSMSETEIVELHKRLEKKNRENKKHHALDAMCLCFAPTGSQIKRFDAKTIMPEGILGREKQYFKSYLDKIVPNEVATQKPRLEQTLYSKRVVGGKECIVRKFNLIDLAYKSGLKPVYDLQTIKKLVGKDQSESDIINPVVGALVREFIATDPTEEQWRAWCGEVCMPSESFTGSRIKRVLVRCGNPDEFKDLSKDGCGAYRKGDAHKGQIVWRSTNGKCYVMPIYVHASKYGLIEALKKRADFKEIVGLFRMHCLVNIERDVVNKNGQKLLPPGIYMLNTIMTKGTAVLTNTDGVKQKEVNMNYLVESGMRPIKVDY

SEQ ID NO: 99 - protein, 1012 aa, unidentified
  REGION 1..1012: note = Description of Unknown:uncultivated organism with predicted taxonomy: unclassifiedVerrucomicrobia (miscellaneous)
  REGION 1..1012: note = MG1-102 effector
ALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 100 - protein, 1059 aa, unidentified
  REGION 1..1059: note = Description of Unknown:uncultivated organism with predicted taxonomy: Verrucomicrobia
  REGION 1..1059: note = MG1-103 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTLPGALTSRIRKFYGLDRILHISAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVKRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 101 - protein, 1062 aa, unidentified; identical to SEQ ID NO: 81
  REGION 1..1062: note = Description of Unknown:uncultivated organism with predicted taxonomy: Verrucomicrobia
  REGION 1..1062: note = MG1-104 effector

SEQ ID NO: 102 - protein, 1059 aa, unidentified
  REGION 1..1059: note = Description of Unknown:uncultivated organism
  REGION 1..1059: note = MG1-105 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 103 - protein, 1073 aa, unidentified
  REGION 1..1073: note = Description of Unknown:uncultivated organism with predicted taxonomy: Verrucomicrobia
  REGION 1..1073: note = MG1-106 effector
MYTKEIIWGFDIGKGSLGEAVRVGNEFKHVQSLEIASDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENVANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWLSSKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAHASKAKVFAALKSNPDCAEVCGFFRQNCLVEISNDVIDKSGKMLLKAGVYRSNSVRSNGQVAITNSDGISPNPISIQYLMPAGMKRIKLDTV

SEQ ID NO: 104 - protein, 1073 aa, unidentified; identical to SEQ ID NO: 84
  REGION 1..1073: note = Description of Unknown:uncultivated organism with predicted taxonomy: Verrucomicrobia
  REGION 1..1073: note = MG1-107 effector

SEQ ID NO: 105 - protein, 1073 aa, unidentified
  REGION 1..1073: note = Description of Unknown:uncultivated organism with predicted taxonomy: Verrucomicrobia
  REGION 1..1073: note = MG1-108 effector
MHTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAELQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATELGKIANTDKNKGLVAGDLDFLKLMSDAPWSGIFIPDVGLSDFADTSEAARAAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 106 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-109 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRSAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 107 - protein, 1073 aa, unidentified
  REGION 1..1073: note = Description of Unknown:uncultivated organism with predicted taxonomy: Verrucomicrobia
  REGION 1..1073: note = MG1-110 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKDKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREEQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGKALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKLEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNPKLSESEWEDWCKNEALIPSKNGAPTKLLRVLCDVGSPEEYKDLSKDGCGAYRKGDSHNGQFIWKTKQGRYVVAPVYAHASKAKVLAALKNNPDCAEVCGFFRQNCLVEIPNDVVDKSGKMLLKSGIYKSNTIMSDGRAKFTNSDGISTNPISIQYLMPAGMKRIKLDTV

SEQ ID NO: 108 - protein, 1062 aa, unidentified; identical to SEQ ID NO: 97
  REGION 1..1062: note = Description of Unknown:uncultivated organism with predicted taxonomy:Coraliomargarita sp. CAG:312
  REGION 1..1062: note = MG1-111 effector

SEQ ID NO: 109 - protein, 1059 aa, unidentified; identical to SEQ ID NO: 96
  REGION 1..1059: note = Description of Unknown:uncultivated organism with predicted taxonomy: unclassifiedVerrucomicrobia (miscellaneous)
  REGION 1..1059: note = MG1-112 effector

SEQ ID NO: 110 - protein, 1034 aa, unidentified
  REGION 1..1034: note = Description of Unknown:uncultivated organism with predicted taxonomy: Verrucomicrobia
  REGION 1..1034: note = MG1-113 effector
MGAEFRHVASLLLDKDFGEIKTAAGLRRQMRTRKAHKAREKWLERCLSDFGIEPLKRREVGIVNGRWMLISKGDERLEREFPPDGEDICYNAIALRCKLLLGEKLESWQIFKALNSAIQNRGYDENIPWKESDVSPSKKDDDDYAKRLSQYSREKSELLESFEGGEKYDYPCFFKAYKMGLWSPENPERVEIRIGNDAQKAKGYVIPRKDVEREFESLVEAASKWHPAMKGKAMYMMYGIAETPYASFKPSLRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRAAFSRPAMLLLKELIFSGMPPAEFYAKKAGEISNADPNKGIVASDLDFIKLMGNCGWNGIFIPDVETYRFANDGADSAKLINGLIGSQNNPIVRHRLAFFYERIKFLESKFGIPDKVVLEFVREDFMGKEQKKRMQIGMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRIKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRENEKHHALDAMCLCFAPTGVNSKRARIDMLLPPDIRGEGKAELFFRKYLDRLIPVDVAPKKPRLEDGIYSMRAVGGKKFMARRVNLVDLAYTVGQKPVYDISVLIGKKNPKEKKIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLPEGVYMVNTIQTDGRGKLTNPNGEKSNLININYLMKAGMRKVSVKDL

SEQ ID NO: 111 - protein, 1077 aa, unidentified
  REGION 1..1077: note = Description of Unknown:uncultivated organism with predicted taxonomy: unclassifiedVerrucomicrobia (miscellaneous)
  REGION 1..1077: note = MG1-114 effector
MSLYFIEQISDWKIMKVIEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 112 - protein, 1061 aa, unidentified
  REGION 1..1061: note = Description of Unknown:uncultivated organism with predicted taxonomy: unclassifiedVerrucomicrobia (miscellaneous)
  REGION 1..1061: note = MG1-115 effector
MKVIEDEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSKEKSELFESFEGGEKYDYPCFFKACKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 113 - protein, 1073 aa, unidentified
  REGION 1..1073: note = Description of Unknown:uncultivated organism with predicted taxonomy: Verrucomicrobia
  REGION 1..1073: note = MG1-116 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLYNPDLKESEWEDWCKYEAAIPSKNGAPTKLLRVLCEVGSPEEYKDLSKDGCGAYRKGDSHKGQFIWKTQKGKYMVAPVYAHASKAKVFASLKNNPDCAEVCGFFRQNCLVEIPNDVIDKSGKMLLKAGVYRSNSVRSNGQVAITNSDGISPNPISIQYLMPAGMKRIKLDTV

SEQ ID NO: 114 - protein, 1062 aa, unidentified
  REGION 1..1062: note = Description of Unknown:uncultivated organism with predicted taxonomy:Coraliomargarita sp. CAG:312
  REGION 1..1062: note = MG1-117 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 115 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-118 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDGYAEIEPPKESGRASFSRPAMEILKELIFSGMPPREFYGRKISEISNTDKNKGVVSSDLDFIKLMGDCPWGGIFIPDVQTYLFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 116 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-119 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKLGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 117 - protein, 1034 aa, unidentified
  REGION 1..1034: note = Description of Unknown:uncultivated organism with predicted taxonomy: unclassifiedVerrucomicrobia (miscellaneous)
  REGION 1..1034: note = MG1-120 effector
MGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPTEFYAKKAGEISNADPNKGIVASDLDFIKLMGNCGWSGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 118 - protein, 1057 aa, unidentified
  REGION 1..1057: note = Description of Unknown:uncultivated organism with predicted taxonomy: unclassifiedVerrucomicrobia (miscellaneous)
  REGION 1..1057: note = MG1-121 effector
KEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISAIALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIWKSGPCVLTNADGEKRNPININYLMRAGMRRVDLSEL

SEQ ID NO: 119 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-122 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 120 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-123 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVGPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 121 - protein, 1073 aa, unidentified
  REGION 1..1073: note = Description of Unknown:uncultivated organism with predicted taxonomy: Verrucomicrobia
  REGION 1..1073: note = MG1-124 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 122 - protein, 1062 aa, unidentified
  REGION 1..1062: note = Description of Unknown:uncultivated organism with predicted taxonomy: Verrucomicrobia
  REGION 1..1062: note = MG1-125 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 123 - protein, 1054 aa, unidentified
  REGION 1..1054: note = Description of Unknown:uncultivated organism with predicted taxonomy: unclassifiedVerrucomicrobia (miscellaneous)
  REGION 1..1054: note = MG1-126 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLVKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 124 - protein, 1073 aa, unidentified; identical to SEQ ID NO: 103
  REGION 1..1073: note = Description of Unknown:uncultivated organism with predicted taxonomy: Verrucomicrobia
  REGION 1..1073: note = MG1-127 effector

SEQ ID NO: 125 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-128 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLQSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 126 - protein, 1073 aa, unidentified
  REGION 1..1073: note = Description of Unknown:uncultivated organism with predicted taxonomy: Verrucomicrobia
  REGION 1..1073: note = MG1-129 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRIIDKCKLIPRLNVCRIKPLDKCKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDIGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 127 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-130 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKPELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPNESAWRKWCEEVRLPSKSGLGARVMRVLVYYGEADEYKDLSKDGCGAYRKGDEHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 128 - protein, 1077 aa, unidentified; identical to SEQ ID NO: 89
  REGION 1..1077: note = Description of Unknown:uncultivated organism with predicted taxonomy: unclassifiedVerrucomicrobia (miscellaneous)
  REGION 1..1077: note = MG1-131 effector

SEQ ID NO: 129 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-132 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 130 - protein, 1062 aa, unidentified
  REGION 1..1062: note = Description of Unknown:uncultivated organism with predicted taxonomy:Coraliomargarita sp. CAG:312
  REGION 1..1062: note = MG1-133 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRLKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRISIKYK

SEQ ID NO: 131 - protein, 1061 aa, unidentified
  REGION 1..1061: note = Description of Unknown:uncultivated organism with predicted taxonomy: unclassifiedVerrucomicrobia (miscellaneous)
  REGION 1..1061: note = MG1-134 effector
MKVMEDEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRMVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 132 - protein, 1058 aa, unidentified
  REGION 1..1058: note = Description of Unknown:uncultivated organism with predicted taxonomy: unclassifiedVerrucomicrobia (miscellaneous)
  REGION 1..1058: note = MG1-135 effector
MEKEKNNHVWGFDIGKGSLGEAVRIGGDFKHIASVLLDPEFGEIKTAALVRRQMRTRKAHKAREKGLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYAVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 133 - protein, 1073 aa, unidentified
  REGION 1..1073: note = Description of Unknown:uncultivated organism with predicted taxonomy: Verrucomicrobia
  REGION 1..1073: note = MG1-136 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVMPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASAAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKKSALEQTIYALRKGRIVKKCNVRDLAYTGINPKYNYSTLVKSIKSIVGEVPKRIVSDFVLSNSDLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 134 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-137 effector
MEKEKNNHVWGFDIGKGSLGEAVRIGGDFKHIASVLLDSEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKIGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 135 - protein, 1059 aa, unidentified; identical to SEQ ID NO: 86
  REGION 1..1059: note = Description of Unknown:uncultivated organism with predicted taxonomy: unclassifiedVerrucomicrobia (miscellaneous)
  REGION 1..1059: note = MG1-138 effector

SEQ ID NO: 136 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-139 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 137 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-140 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNMGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 138 - protein, 1073 aa, unidentified
  REGION 1..1073: note = Description of Unknown:uncultivated organism with predicted taxonomy: Verrucomicrobia
  REGION 1..1073: note = MG1-141 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCRIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPADFYATAIENIANTDKNKGLVAGDLDFLKLMGDAPWSGIFIPDVGLSDFADASEAARAAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTALAETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSVRSNGQVAITNSDGISPNPISIQYLMPAGMKRIKLDTV

SEQ ID NO: 139 - protein, 1060 aa, unidentified
  REGION 1..1060: note = Description of Unknown:uncultivated organism with predicted taxonomy: unclassifiedVerrucomicrobia (miscellaneous)
  REGION 1..1060: note = MG1-142 effector
MKVMEGEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYENIPWNESDASPSKKEDGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELFEKQGGVCLYTGEPLLPSELGILEIEHIVPRSRGGPDAQYNYVLTREKTNKEKADRTPFEWLSSDPVRWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRMVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGCGAFRRGDGHKGQIVWESTDGKYYVLPIYVHASKAKLLAELCANPKKKRICGIFTSHCMVKVGNTYNNKGELLLPEGVYMVNTIRTDGWIQLTSANGDKSKPININYLMKAGMKKVLVKDL

SEQ ID NO: 140 - protein, 905 aa, unidentified
  REGION 1..905: note = Description of Unknown:uncultivated organism with predicted taxonomy: Verrucomicrobiabacterium
  REGION 1..905: note = MG1-143 effector
KESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPAFRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLMKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGERKAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLSEGVYMVNTIRTDGWIQLTSANGDKSKPININYLMKAGMRKVSVKDL

SEQ ID NO: 141 - protein, 1025 aa, unidentified
  REGION 1..1025: note = Description of Unknown:uncultivated organism with predicted taxonomy: unclassifiedVerrucomicrobia (miscellaneous)
  REGION 1..1025: note = MG1-144 effector
LLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSKEKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRVEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 142 - protein, 1073 aa, unidentified
  REGION 1..1073: note = Description of Unknown:uncultivated organism with predicted taxonomy: Verrucomicrobia
  REGION 1..1073: note = MG1-145 effector
MYTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKLFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEKSKLEQTIYSLRKGRIVKKCNVRDLAYTGINPKYNYSTLVKSIKSIVGEVPKRIVSDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKAGVYRSNSVKSNGQVAITNSDGISPNPISIQYLMPAGMKRIKLDTV

SEQ ID NO: 143 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-147 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAIEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGVRVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 144 - protein, 938 aa, unidentified
  REGION 1..938: note = Description of Unknown:uncultivated organism with predicted taxonomy: unclassifiedVerrucomicrobia (miscellaneous)
  REGION 1..938: note = MG1-148 effector
KLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLFNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 145 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-149 effector
MEKEKNNHVWGFDIGKGSLGEAVRIGGDFKHIASVLLDPEFGEIKTAALACRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVTACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 146 - protein, 1062 aa, unidentified
  REGION 1..1062: note = Description of Unknown:uncultivated organism with predicted taxonomy:Coraliomargarita sp. CAG:312
  REGION 1..1062: note = MG1-150 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIRKDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 147 - protein, 1034 aa, unidentified
  REGION 1..1034: note = Description of Unknown:uncultivated organism with predicted taxonomy: Verrucomicrobia
  REGION 1..1034: note = MG1-151 effector
MGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVTGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLPEGVYMVNTIQTDGRGKLTNTNGDKSKPININYLMKAGMRKVSVKDL

SEQ ID NO: 148 - protein, 874 aa, unidentified; identical to SEQ ID NO: 88
  REGION 1..874: note = Description of Unknown:uncultivated organism
  REGION 1..874: note = MG1-152 effector

SEQ ID NO: 149 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-153 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAVKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPMDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 150 - protein, 1073 aa, unidentified
  REGION 1..1073: note = Description of Unknown:uncultivated organism with predicted taxonomy: Verrucomicrobia
  REGION 1..1073: note = MG1-154 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLVHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 151 - protein, 1074 aa, unidentified
  REGION 1..1074: note = Description of Unknown:uncultivated organism with predicted taxonomy: Verrucomicrobia
  REGION 1..1074: note = MG1-155 effector
MGTKEIVWGFDIGKGSLGEAVRIGNEFKHVQSLEIPPEFAETKTAAALRRAWRTRHAHKARELWLERCLSNAGIEVLGRRKVDIVGGRWKLVSEGDRRLEREFPADGEDCCYNSIALRCKLLLGEKLESWQVFKALNSAIQTRGYDAKIPWGNGNGKTPDSAKGEKSEAVKEEDSYAEKLALYEREFDGLLAEVNNRKKYDFPCFFKAAKIGLWSPENPDVVKIRIDNTAEKAKGYVVPRSAVVSEFRALVEAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFIPDVAAFDFANSTEFSRAVQINKLIGLQNDPIVRHRLSFFYERIKSLEAKFGTPDKIVLEFVRDDFLGKKAKADLSRAINDRAKERKKYAEELDSQREIFGSKYASKKMLLKYELYSKQKGVCVYTGNALGFSNLEQLEVEHIVPRSRGGPDALYNYVLTDEKTNKEKGDRTPFEWLSSKGLEWESYCQRVRELTKEFGAKRCRLLLSPNAEELVEKYTALAETAWISKLAQRVCCIHFGFQFGGLTGVKKVWTVSGNTTAMIRSRYGLNRLLHDENVPKDISLSERLKLENDFEKKNRDNKKHHALDAMCLCYAPTSNTRRAASYKNILPAEITRNPESDEARRFFGRYLANVIPNKVAIEKPTLEQTIYAKRLINGKETIVKKCNVRDLAYAGINPKYDLGKLKDRIRDIINPVSKRVISDFVNSNPNLSESEWEDWCRHEASIPSKSGKATRLLRVQCAVGDPAEYKDLSKDGCGAYRKGKSHKGQYIWKTKGGRYVVTPVYTFASKIRVYDDMRRDPNCEEICGFFRQNCLVEIPNDVYDSKGVWKLKAGIYRSNTIRADGFVKLTNSDGFSSNPISIQYLMTAGMKRITLDTI

SEQ ID NO: 152 - protein, 891 aa, unidentified
  REGION 1..891: note = Description of Unknown:uncultivated organism with predicted taxonomy:Coraliomargarita sp. CAG:312
  REGION 1..891: note = MG1-156 effector
LYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 153 - protein, 1055 aa, unidentified
  REGION 1..1055: note = Description of Unknown:uncultivated organism with predicted taxonomy: Verrucomicrobia
  REGION 1..1055: note = MG1-157 effector
MENRVNIWGFDIGKGSLGEAVRIGSEIKHVQSLILDKDFGEIKTAAGIRRQYRTRKAHRAREKFLEKVLGECGIEVLRRREVGIVDGCWKLIAKGDIRLEKEFPSPGEDVCYNSIALRCKLLLGEPLESWQVFKALNSAIQNRGYDPDIPWTETDADKKEDSDWAKRLSAYEDEKKVLFSGLADPQRYDYPCFFKAYKMGLWSPEDPEIVKLRIDNHAEKAKNYVIPRKCVEAEFEKLVENASLQYPKLKGKALYIMFGPAQKEYASLNPELRRQFNLKRGADTDWTALGQKIPRFDNRIVDKCKLMPRFNVCKIKPLDEIKNPADFLPYEITTLMKLLNLRFLRNGTIESLACDELKEAFELARDNKYKLSKTALKKFLKKIGAEVLDEDQSKIEAPRSGGRASFSRPAMAVLKELILSGESPAKFYARKVSQIENTDKLKGLVASDFDFIKQMGDIAWGKIFMPDMRLLEFANRQNIDAEARINKLIGSQNDPIVRHRLGFFYDRIKFLESKFGVPDKIVIEFVRDDFLGEKAKKEYQKAINERFKEKQELAKEMDEAGYKGAKMLLKLELYKKQGGQCVYTGEALPSSEIASLEIEHIVPRSRGGPDSIYNYVLTRERTNKEKADRTPYEWLSRDQQRWNAYVSRVNSLYKSLGGKRCKLLLANNAEELVDKYTALAETAWISKLAQQVVCLHFGFQFGGMEGQRRVFCIPGGVTARIRGMFGLNELLHVKDYDTDSMSETEIVELYKRLEKKNRENKKHHALDAMCLCFAPTGSQIKRFDAKTIMPEGILGREKQYFKSYLDKIVPNEVATQKPRLEQTLYSKRVVGGKECIVRKFNLVDLAYKSGLKPVYDLQTIKKLVGKDQSESDIINPVVGALVREFIATDPTEEQWRAWCGEVCMPSESFTGSRIKRVLVRCGNPDEFKDLSKDGCGAYRKGDAHKGQTVWRSTNGKCYVLPIYVHASKYGLIEALKKRADFKEIVGLFRMHCLVNIERDVFDKKGQKLLPPGIYMLNTLRADSQALLTNTDGVKQKAININYLVESGMRPIKVDY

SEQ ID NO: 154 - protein, 1061 aa, unidentified
  REGION 1..1061: note = Description of Unknown:uncultivated organism with predicted taxonomy: unclassifiedVerrucomicrobia (miscellaneous)
  REGION 1..1061: note = MG1-158 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVTARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 155 - protein, 1052 aa, unidentified
  REGION 1..1052: note = Description of Unknown:uncultivated organism with predicted taxonomy:Coraliomargarita sp. CAG:312
  REGION 1..1052: note = MG1-159 effector
MDILGNKVWGFDMGKGSLGEAVRIGNEFKHVCSLLLDADFGEIKTAASLRRQYRTHKAHKAREKWLEDCLRKCGIEVLQRRQVAFVDDKWQLVSKGDIRLEKEFPTDDENICYNSIALRCKLILGEKLESWQVFKALNSAIQNRGYDSEIPWKETEVKSKDNSDYAIKLQAFEREKDELLLNLPSIDEAIRSKFDYPCFFKAYKIGLWNPVNPNQVDSKISHTANKAKGYVIPRNYVEKEFIKLVEMASLQYPKLRNKALFILYGITEKPYASFDFDLRKKFNLKRGAESDWTALGQKIPRFDNRIVDKCKLIPRFNVCKVKHIDEIQQDKDFLYYEITLAMKLLNLRFYRNANVQSLNYDEFKILFEIGKANKFKITKTNLKKFLNSINAEILDENQAEVAQPKDSGRASFSRPAMQLIKELIFSGQSPADFYARKVSSISNVETKKGLVVEDLDFIKLMGDVDWNGIFIPDVETYKFAKNFSEDNSAQINKLIGMQNDPIVRHRLSFFYDRIKYLEAKFGIPDKVVLEFVRDDFIGKEKKKELNIAIKKRYSEKLKIAEKLDEIGFKGSKMLMKLELFQKQGGICLYTREPLLPTEIPSLEIEHIVPRSRGGPDSAYNFVLTREATNKEKANRTPFEWLSGDSQKWVSYSDRVMSRSKELGKKRCQLLLKENAEELVEKYTALAETAWIARLAQRIVCMHFGFPMGALIGKKRVFTVSGSVTSRIRGMYGLNKILHNTEIDKTLSEVDILKLNDSLETKNRANKKHHALDAMCLCFAPTSKEVLNKNREILPVEIAKDAENYFRRYLDNIIPNKVATMKPRLEETIYSKRKIGKKEYIVRKYDLESLAYKGINPKYDVESIKKLANSENIINVVARKIIRDFVNDNPTEQEWKDFCNTVKMPSKNGNGSRLKRILLLVGNTAEYKDLSKDGCGAYRKGDSHKGQIIWKTKSGKFKVEPIYAHSSRAKVSKELMKKPEFDSVAGIFRTGCLVEFTNDVMNDKDEFLLERGIYSLNTISTAGQVAITNSNGNKSIGININYLMKAGMRRLNL

SEQ ID NO: 156 - protein, 933 aa, unidentified
  REGION 1..933: note = Description of Unknown:uncultivated organism with predicted taxonomy: unclassifiedVerrucomicrobia (miscellaneous)
  REGION 1..933: note = MG1-160 effector
EKLEGWQVFTALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISPTALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 157 - protein, 1074 aa, unidentified
  REGION 1..1074: note = Description of Unknown:uncultivated organism with predicted taxonomy: Verrucomicrobia
  REGION 1..1074: note = MG1-161 effector
MGTKEIVWGFDIGKGSLGEAVRIGNEFKHVQSLEIPPEFAETKTAAALRRAWRTRHAHKARELWLERCLSNAGIEVLGRRKVDIVGGRWKLVSEGDRRLEREFPADGEDCCYNSIALRCKLLLGEKLESWQVFKALNSAIQTRGYDAKIPWGNDDGKTSDSAKGGKSEAAKEEESYAEKLALYEREFDGLLAEVDNRKKYDFPCFFKAAKIGLWSPANPDAVKIRIDNTAEKAKGYVVPRSAVIAEFRALVDAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLIEGRETIVKKCNVRDLAYAGINPKYDLGKLKDRIRDIINPVSKRVISDFVNSNPNLSESEWEDWCRHEASIPSKSDKATRLLRVQCAVGDPAEYKDLSKDGCGAYRKGKSHKGQYIWKTKGGRYVVTPVYTFASKIRVYDDMRRDPNCEEICGFFRQNCLVEIPNDVYDNKGVLKLKAGIYRSNTIKTNGQVNLTTPNGIKFNGISIQYLMSAGMKRITLNTI

SEQ ID NO: 158 - protein, 1062 aa, unidentified
  REGION 1..1062: note = Description of Unknown:uncultivated organism with predicted taxonomy:Coraliomargarita sp. CAG:312
  REGION 1..1062: note = MG1-162 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIIGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNSKRDVLLSPGTYMINTIMAAGMAILSDTNGVKSPAININYLMNAGMRRISIKYK

SEQ ID NO: 159 - protein, 1063 aa, unidentified
  REGION 1..1063: note = Description of Unknown:uncultivated organism with predicted taxonomy: unclassifiedVerrucomicrobia (miscellaneous)
  REGION 1..1063: note = MG1-163 effector
MKVIEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLPREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSFEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 160 - protein, 1074 aa, unidentified
  REGION 1..1074: note = Description of Unknown:uncultivated organism with predicted taxonomy: Verrucomicrobia
  REGION 1..1074: note = MG1-164 effector
MHTKETVWGFDIGKGSLGEAVRVGNEFKHVLSMEIDADFAEIKTAAATRRAWRTREAHKAREMWLEKCLSDADIEILGRRKVDIVDGTWKLVSRGDGRLEREFPADGENVCYNSIALRCKLLLGEKLESWQVFKALNSAIQNRGYDAQIPWGDEDGKSSETKRSGKSDSAKKSGEDESYAERLALFEREFDKLLAEVENREKYDFPCFFKAAKMGLWSPENPDKVGIRIDNTAEKAKGYVVPRNAVIAEFRALVNAAAKQYPKLKGKADFIMFGKAEEAYASYKPELRRKFGLRRGADSDWTALGQKTPRFDNRIIGKCKLIPRLNVCKIKPLKECKTEDDFLPHTITLALKLLNLRFFRGAGIDSLSFDEFLRAFEIARQNKFALNKTNLKKFFKTIGAEIMDENQSSVEQPREGGRAAYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGERTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARKFFAKYLAEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLVEIGNPEEYKDLSKDGCGAYRKGDSHKGQFIWKNKKGRYIVAPIYAHASKAKVLDDLQNNPDCAEICGFFRTNCLVKIPNDVADKDGKILLKAGFYKSNTIKTEGRVKLTNPNGIITEIGLQHLMNAGMKRVETNTI

SEQ ID NO: 161 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-165 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEMRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 162 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-166 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDGQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKGLGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLEKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGEFILPAGRYMVNTIRSDNQCVLTNADGEKRNPININYLMRAGMRRVDLSEL

SEQ ID NO: 163 - protein, 1055 aa, unidentified
  REGION 1..1055: note = Description of Unknown:uncultivated organism with predicted taxonomy: unclassifiedVerrucomicrobia (miscellaneous)
  REGION 1..1055: note = MG1-167 effector
KNNHVWGFDIGKGSLGEAVRIGGDFKHIASVLLDPEFGEIKTAALARRQMRTRKAHKAREKWLEECLEGTGVEILKRREVGIVDGQWRLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAVFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 164 - protein, 988 aa, unidentified
  REGION 1..988: note = Description of Unknown:uncultivated organism with predicted taxonomy: Verrucomicrobia
  REGION 1..988: note = MG1-168 effector
GRWKLVSEGDRRLEREFPADGEDCCYNSIALRCKLLLGEKLESWQVFKALNSAIQTRGYDAKIPWGNDDGKTSDSAKGGKSEAAKEEESYAEKLALYEREFDGLLAEVDNRKKYDFPCFFKAAKIGLWSPANPDAVKIRIDNTAEKAKGYVVPRSAVIAEFRALVDAAAKQYPALKGKADFIMFGVSEEPYASYNPELRKKFGLERGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLINGKETIVKKCNVRDLAYAGRNPQYSYLTLVKNIKCIVGKVSKNIISDFVLSNPDLNESEWENWCKYDAVIPSKNGAPTKLLRVLCGARNPEEYKDLSKDGCGAYRKGNLHKGQFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 165 - protein, 991 aa, unidentified
  REGION 1..991: note = Description of Unknown:uncultivated organism with predicted taxonomy: unclassifiedVerrucomicrobia (miscellaneous)
  REGION 1..991: note = MG1-169 effector
ECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 166 - protein, 872 aa, unidentified
  REGION 1..872: note = Description of Unknown:uncultivated organism with predicted taxonomy: unclassifiedVerrucomicrobia (miscellaneous)
  REGION 1..872: note = MG1-170 effector
DGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 167 - protein, 1064 aa, unidentified
  REGION 1..1064: note = Description of Unknown:uncultivated organism with predicted taxonomy: unclassifiedVerrucomicrobia (miscellaneous)
  REGION 1..1064: note = MG1-171 effector
EFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGDNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 168 - protein, 1073 aa, unidentified; identical to SEQ ID NO: 133
  REGION 1..1073: note = Description of Unknown:uncultivated organism with predicted taxonomy: Verrucomicrobia
  REGION 1..1073: note = MG1-172 effector

SEQ ID NO: 169 - protein, 1046 aa, unidentified
  REGION 1..1046: note = Description of Unknown:uncultivated organism with predicted taxonomy: unclassifiedVerrucomicrobia (miscellaneous)
  REGION 1..1046: note = MG1-173 effector
IGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACTKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKSDFILPAGRYMVNTIRSDNQCVLTNADGEKRNPININYLMRAGMRRVDLSEL

SEQ ID NO: 170 - protein, 1059 aa, unidentified; identical to SEQ ID NO: 86
  REGION 1..1059: note = Description of Unknown:uncultivated organism with predicted taxonomy: unclassifiedVerrucomicrobia (miscellaneous)
  REGION 1..1059: note = MG1-174 effector

SEQ ID NO: 171 - protein, 918 aa, unidentified
  REGION 1..918: note = Description of Unknown:uncultivated organism with predicted taxonomy:Coraliomargarita sp. CAG:312
  REGION 1..918: note = MG1-175 effector
AADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKSKLEQTIYSLRKGRIVKKCNVRDLAYEGINPKYNYTKLVKRIESIVGDVSKRIISDFVLSNPDLNESEWEEWCKYKAAIPSKNGAPTKLLRVLFDVGSPEEYKDLSKDGCGAYRKGDSHKGQFIWKTQKGKYMVAPVYAHASKAKVFASLKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 172 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-176 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 173 - protein, 1073 aa, unidentified; identical to SEQ ID NO: 142
  REGION 1..1073: note = Description of Unknown:uncultivated organism with predicted taxonomy: Verrucomicrobia
  REGION 1..1073: note = MG1-177 effector

SEQ ID NO: 174 - protein, 1052 aa, unidentified; identical to SEQ ID NO: 155
  REGION 1..1052: note = Description of Unknown:uncultivated organism with predicted taxonomy:Coraliomargarita sp. CAG:312
  REGION 1..1052: note = MG1-178 effector

SEQ ID NO: 175 - protein, 846 aa, unidentified
  REGION 1..846: note = Description of Unknown:uncultivated organism with predicted taxonomy:Coraliomargarita sp. CAG:312
  REGION 1..846: note = MG1-179 effector
TLFRSAEKAKGYVVPREAVVREFRALVNAAALQYPNLKGKADFIMFGRACEPYASYNPELRKRFGLKRGAATDWTALGQKTPRFDNRVIDKCKLIPRLNVCRIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPADFYATAIENIANTDKNKGLVAGDLDFLKLMGDAPWSGIFIPDVGLSDFADASEAARAAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTALAETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSVRSNGQVAITNSDGISPNPISIQYLMPAGMKRIKLDTV

SEQ ID NO: 176 - protein, 1018 aa, unidentified
  REGION 1..1018: note = Description of Unknown:uncultivated organism with predicted taxonomy: unclassifiedVerrucomicrobia (miscellaneous)
  REGION 1..1018: note = MG1-180 effector
IASVLLDPEFGEIKTAALVRRQMRTRKAHKAREKWLEECLEGTGVVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEMRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATSLGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGVSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 177 - protein, 1077 aa, unidentified; identical to SEQ ID NO: 111
  REGION 1..1077: note = Description of Unknown:uncultivated organism with predicted taxonomy: unclassifiedVerrucomicrobia (miscellaneous)
  REGION 1..1077: note = MG1-181 effector

SEQ ID NO: 178 - protein, 1061 aa, unidentified; identical to SEQ ID NO: 112
  REGION 1..1061: note = Description of Unknown:uncultivated organism with predicted taxonomy: unclassifiedVerrucomicrobia (miscellaneous)
  REGION 1..1061: note = MG1-182 effector

SEQ ID NO: 179 - protein, 1062 aa, unidentified; identical to SEQ ID NO: 92
  REGION 1..1062: note = Description of Unknown:uncultivated organism with predicted taxonomy:Coraliomargarita sp. CAG:312
  REGION 1..1062: note = MG1-183 effector

SEQ ID NO: 180 - protein, 1059 aa, unidentified; identical to SEQ ID NO: 127
  REGION 1..1059: note = Description of Unknown:uncultivated organism with predicted taxonomy: unclassifiedVerrucomicrobia (miscellaneous)
  REGION 1..1059: note = MG1-184 effector

SEQ ID NO: 181 - protein, 1062 aa, unidentified; identical to SEQ ID NO: 122
  REGION 1..1062: note = Description of Unknown:uncultivated organism with predicted taxonomy:Coraliomargarita sp. CAG:312
  REGION 1..1062: note = MG1-185 effector

SEQ ID NO: 182 - protein, 1054 aa, unidentified; identical to SEQ ID NO: 123
  REGION 1..1054: note = Description of Unknown:uncultivated organism with predicted taxonomy: unclassifiedVerrucomicrobia (miscellaneous)
  REGION 1..1054: note = MG1-186 effector

SEQ ID NO: 183 - protein, 957 aa, unidentified
  REGION 1..957: note = Description of Unknown:uncultivated organism with predicted taxonomy: Verrucomicrobia
  REGION 1..957: note = MG1-187 effector
LRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYEGINPKYNYTKLVKRIESIVGDVSKRIISDFVLSNPDLNESEWEEWCKYKAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 184 - protein, 1062 aa, unidentified
  REGION 1..1062: note = Description of Unknown:uncultivated organism with predicted taxonomy: Verrucomicrobia
  REGION 1..1062: note = MG1-188 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQENSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKTKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 185 - protein, 1073 aa, unidentified; identical to SEQ ID NO: 113
  REGION 1..1073: note = Description of Unknown:uncultivated organism with predicted taxonomy: Verrucomicrobia
  REGION 1..1073: note = MG1-189 effector

SEQ ID NO: 186 - protein, 1059 aa, unidentified; identical to SEQ ID NO: 90
  REGION 1..1059: note = Description of Unknown:uncultivated organism with predicted taxonomy: unclassifiedVerrucomicrobia (miscellaneous)
  REGION 1..1059: note = MG1-190 effector

SEQ ID NO: 187 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-191 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGENVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 188 - protein, 1081 aa, unidentified
  REGION 1..1081: note = Description of Unknown:uncultivated organism with predicted taxonomy: unclassifiedVerrucomicrobia (miscellaneous)
  REGION 1..1081: note = MG1-192 effector
YYIVDFCSHCKYFNNNKEFNKNMEKEKNNHVWGFDIGKGSLGEAVRIGGDFKHIASVLLDPEFGEIKTAALVRRQMRTRKAHKAREKWLEECLEGTGIEILKRREVGIVDGQWRLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLSEL

SEQ ID NO: 189 - protein, 1073 aa, unidentified; identical to SEQ ID NO: 150
  REGION 1..1073: note = Description of Unknown:uncultivated organism with predicted taxonomy: Verrucomicrobia
  REGION 1..1073: note = MG1-193 effector

SEQ ID NO: 190 - protein, 1059 aa, unidentified; identical to SEQ ID NO: 129
  REGION 1..1059: note = Description of Unknown:uncultivated organism with predicted taxonomy: unclassifiedVerrucomicrobia (miscellaneous)
  REGION 1..1059: note = MG1-194 effector

SEQ ID NO: 191 - protein, 1059 aa, unidentified; identical to SEQ ID NO: 93
  REGION 1..1059: note = Description of Unknown:uncultivated organism with predicted taxonomy: unclassifiedVerrucomicrobia (miscellaneous)
  REGION 1..1059: note = MG1-195 effector

SEQ ID NO: 192 - protein, 935 aa, unidentified
  REGION 1..935: note = Description of Unknown:uncultivated organism with predicted taxonomy: Verrucomicrobia
  REGION 1..935: note = MG1-196 effector
MGAEFRHVTSLLLDEDFGEIKTAAGLRRQIRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPAFRKKFDLKRGAESDWTALGQKIPRFDNRIIDKCRPIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPTEDEWRKWCGECRLPSKNGIGTRVIRVLLNYGEPAEYKDLSKDGRGAFRRGDGHKGQIVWESTDGK

SEQ ID NO: 193 - protein, 1059 aa, unidentified; identical to SEQ ID NO: 116
  REGION 1..1059: note = Description of Unknown:uncultivated organism with predicted taxonomy: unclassifiedVerrucomicrobia (miscellaneous)
  REGION 1..1059: note = MG1-197 effector

SEQ ID NO: 194 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-198 effector
MEKEKNNHVWGFDIGIGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPCFDNRIIDKCRLIPRMNVCKIRPLNEARNEKDLLYYEVTLALKLLNLRFFRNSNIEQLTFEEFKEAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 195 - protein, 899 aa, unidentified
  REGION 1..899: note = Description of Unknown:uncultivated organism with predicted taxonomy: unclassifiedVerrucomicrobia (miscellaneous)
  REGION 1..899: note = MG1-199 effector
SKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPCFDNRIIDKCRLIPRMNVCKIRPLNEARNEKDLLYYEVTLALKLLNLRFFRNSNIEQLTFEEFKEAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 196 - protein, 1073 aa, unidentified
  REGION 1..1073: note = Description of Unknown:uncultivated organism
  REGION 1..1073: note = MG1-200 effector
MYTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYECIKSLEAKFGVPDKIVLEFVRDDFLGKKAKSDLNKAIKTRFDEKKKLAEDLDSKREEFGFKYASKKMLLKFELYKKQGGKCVYTGNALPLSELESLEIEHIVPRSRGGPDAMYNYVLTDEKTNKEKGDRTPFEWLSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNPKLSESEWEDWCKNEALIPSKNGAPTKLLRVLCDVGSPEEYKDLSKDGCGAYRKGDSHKGQFIWETKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 197 - protein, 1073 aa, unidentified; identical to SEQ ID NO: 121
  REGION 1..1073: note = Description of Unknown:uncultivated organism with predicted taxonomy: Verrucomicrobia
  REGION 1..1073: note = MG1-201 effector

SEQ ID NO: 198 - protein, 1073 aa, unidentified
  REGION 1..1073: note = Description of Unknown:uncultivated organism with predicted taxonomy:Coraliomargarita sp. CAG:312
  REGION 1..1073: note = MG1-202 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYYPELRKRFGLKRGAATDWTALGQKTPRFDNRVIDKCKLIPRLNVCEIKPLDKCKTDDDFLSYTITLSLKLLNLRFFRGAGVDSLSFDEFLRAFELAKNSKFKLGKAALKKFFKTIGAEVMDESQSEIEQPRNEGRAAFSRPAMRILRDLIFSGKSPAEFYAAAIENIANTDKNKGLVAGDLDFLKLMGDAPWSGIFIPDVGLSDFADTSEAAREAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLAPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYEGINPKYNYTKLVKRIESIVGDVSKRIISDFVLSNPDLNESEWEEWCKYKAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 199 - protein, 1062 aa, unidentified; identical to SEQ ID NO: 146
  REGION 1..1062: note = Description of Unknown:uncultivated organism with predicted taxonomy:Coraliomargarita sp. CAG:312
  REGION 1..1062: note = MG1-203 effector

SEQ ID NO: 200 - protein, 1073 aa, unidentified; identical to SEQ ID NO: 107
  REGION 1..1073: note = Description of Unknown:uncultivated organism with predicted taxonomy: Verrucomicrobia
  REGION 1..1073: note = MG1-204 effector

SEQ ID NO: 201 - protein, 759 aa, unidentified
  REGION 1..759: note = Description of Unknown:uncultivated organism with predicted taxonomy:Coraliomargarita sp. CAG:312
  REGION 1..759: note = MG1-205 effector
FPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKSKLEQTIYSLRKGRKIGRA

SEQ ID NO: 202 - protein, 1062 aa, unidentified; identical to SEQ ID NO: 130
  REGION 1..1062: note = Description of Unknown:uncultivated organism with predicted taxonomy:Coraliomargarita sp. CAG:312
  REGION 1..1062: note = MG1-206 effector

SEQ ID NO: 203 - protein, 1036 aa, unidentified
  REGION 1..1036: note = Description of Unknown:uncultivated organism with predicted taxonomy: unclassifiedVerrucomicrobia (miscellaneous)
  REGION 1..1036: note = MG1-207 effector
MKVMEAENGNHIWGFDIGKGSLGEAVLMGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARDEGDLLHYEITLSLKLLNLRFFRNSNVESLSFEEFKAAFEIAKGAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPTEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIKTDGRGKLTNPN

SEQ ID NO: 204 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-208 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 205 - protein, 1059 aa, unidentified; identical to SEQ ID NO: 106
  REGION 1..1059: note = Description of Unknown:uncultivated organism with predicted taxonomy: unclassifiedVerrucomicrobia (miscellaneous)
  REGION 1..1059: note = MG1-209 effector

SEQ ID NO: 206 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-210 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 207 - protein, 1062 aa, unidentified; identical to SEQ ID NO: 83
  REGION 1..1062: note = Description of Unknown:uncultivated organism with predicted taxonomy:Coraliomargarita sp. CAG:312
  REGION 1..1062: note = MG1-211 effector

SEQ ID NO: 208 - protein, 1059 aa, unidentified; identical to SEQ ID NO: 85
  REGION 1..1059: note = Description of Unknown:uncultivated organism with predicted taxonomy: unclassifiedVerrucomicrobia (miscellaneous)
  REGION 1..1059: note = MG1-212 effector

SEQ ID NO: 209 - protein, 798 aa, unidentified
  REGION 1..798: note = Description of Unknown:uncultivated organism with predicted taxonomy: unclassifiedVerrucomicrobia (miscellaneous)
  REGION 1..798: note = MG1-213 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLR

SEQ ID NO: 210 - protein, 920 aa, unidentified
  REGION 1..920: note = Description of Unknown:uncultivated organism with predicted taxonomy: unclassifiedVerrucomicrobia (miscellaneous)
  REGION 1..920: note = MG1-214 effector
MLEVAAYAHGLAERAFSDVKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRCAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 211 - protein, 1059 aa, unidentified; identical to SEQ ID NO: 137
  REGION 1..1059: note = Description of Unknown:uncultivated organism with predicted taxonomy: unclassifiedVerrucomicrobia (miscellaneous)
  REGION 1..1059: note = MG1-215 effector

SEQ ID NO: 212 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-216 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDQLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVIIREKTNKLKGDKTPYEWLSSDAKEWASYTDRVNACAKALGKKRCRLLLEKDAEELVEKYTALAETAHIAKLAQKIVCMHFGFQFGGLSGAKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 213 - protein, 777 aa, unidentified
  REGION 1..777: note = Description of Unknown:uncultivated organism with predicted taxonomy:Coraliomargarita sp. CAG:312
  REGION 1..777: note = MG1-217 effector
GSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 214 - protein, 1059 aa, unidentified; identical to SEQ ID NO: 125
  REGION 1..1059: note = Description of Unknown:uncultivated organism with predicted taxonomy: unclassifiedVerrucomicrobia (miscellaneous)
  REGION 1..1059: note = MG1-218 effector

SEQ ID NO: 215 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-219 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 216 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-220 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEGKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCHLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 217 - protein, 759 aa, unidentified
  REGION 1..759: note = Description of Unknown:uncultivated organism with predicted taxonomy: unclassifiedVerrucomicrobia (miscellaneous)
  REGION 1..759: note = MG1-221 effector
FNNNKEFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFAVPGALTSRIRKFYGLDRILHNSEAESENLSFEE

SEQ ID NO: 218 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-222 effector
MEKEKNNHVWGFDIGKGSLGEAVRIGGDFKHISSVLLDPEFGEIKTAALARRQMRTRKAHKAREKWLEECLEGTGVEILKRREVGIVDGQWQLISKGDERLEREFPPSDEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVGPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 219 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-223 effector
MEKEKNNHVWGFDIGKGSLGEAVRIGGDFKHIASVLLDPEFGEIKTAALVRRQMRTRKAHKAREKWLEECLEGMGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGRLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 220 - protein, 1025 aa, unidentified; identical to SEQ ID NO: 141
  REGION 1..1025: note = Description of Unknown:uncultivated organism with predicted taxonomy: unclassifiedVerrucomicrobia (miscellaneous)
  REGION 1..1025: note = MG1-224 effector

SEQ ID NO: 221 - protein, 1062 aa, unidentified; identical to SEQ ID NO: 81
  REGION 1..1062: note = Description of Unknown:uncultivated organism with predicted taxonomy:Coraliomargarita sp. CAG:312
  REGION 1..1062: note = MG1-225 effector

SEQ ID NO: 222 - protein, 1062 aa, unidentified; identical to SEQ ID NO: 114
  REGION 1..1062: note = Description of Unknown:uncultivated organism with predicted taxonomy:Coraliomargarita sp. CAG:312
  REGION 1..1062: note = MG1-226 effector

SEQ ID NO: 223 - protein, 899 aa, unidentified
  REGION 1..899: note = Description of Unknown:uncultivated organism with predicted taxonomy:Coraliomargarita sp. CAG:312
  REGION 1..899: note = MG1-227 effector
MNNNNTQIWGFDIGKASLGEAVWCGGEFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIIGDCPWNGIFIPDVETYKYASQTQESSEAQINKLIGSQNDPIVRHRLSFFYERIKALSEKFGVPDKIVLEFVREDFMGKQAKKDLSLYMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNED

SEQ ID NO: 224 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-228 effector
MEKEKNNHVWGFDIGKGSIGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLGFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSEAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFTATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVCNDKGDFILPAGRYMVNTILTTGRCVLTNADGEKRNPININYLMRAGMRRVDLNEL

SEQ ID NO: 225 - protein, 1059 aa, unidentified
  REGION 1..1059: note = Description of Unknown:uncultivated organism with predicted taxonomy: Verrucomicrobia
  REGION 1..1059: note = MG1-229 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETSYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGYDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLNEL

SEQ ID NO: 226 - protein, 1059 aa, unidentified
  REGION 1..1059: note = Description of Unknown:uncultivated organism with predicted taxonomy: Verrucomicrobia
  REGION 1..1059: note = MG1-230 effector
MEKEKNNHVWGFDIGKGSLGEAVCIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTTLAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 227 - protein, 1059 aa, unidentified; identical to SEQ ID NO: 87
  REGION 1..1059: note = Description of Unknown:uncultivated organism with predicted taxonomy: unclassifiedVerrucomicrobia (miscellaneous)
  REGION 1..1059: note = MG1-231 effector

SEQ ID NO: 228 - protein, 1073 aa, unidentified; identical to SEQ ID NO: 126
  REGION 1..1073: note = Description of Unknown:uncultivated organism with predicted taxonomy: Verrucomicrobia
  REGION 1..1073: note = MG1-232 effector

SEQ ID NO: 229 - protein, 1034 aa, unidentified; identical to SEQ ID NO: 110
  REGION 1..1034: note = Description of Unknown:uncultivated organism
  REGION 1..1034: note = MG1-233 effector

SEQ ID NO: 230 - protein, 1058 aa, unidentified
  REGION 1..1058: note = Description of Unknown:uncultivated organism with predicted taxonomy: unclassifiedVerrucomicrobia (miscellaneous)
  REGION 1..1058: note = MG1-234 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYAVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 231 - protein, 1059 aa, unidentified; identical to SEQ ID NO: 115
  REGION 1..1059: note = Description of Unknown:uncultivated organism with predicted taxonomy: unclassifiedVerrucomicrobia (miscellaneous)
  REGION 1..1059: note = MG1-236 effector

SEQ ID NO: 232 - protein, 1056 aa, unidentified
  REGION 1..1056: note = Description of Unknown:uncultivated organism with predicted taxonomy: Verrucomicrobia
  REGION 1..1056: note = MG1-237 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 233 - protein, 1062 aa, unidentified; identical to SEQ ID NO: 97
  REGION 1..1062: note = Description of Unknown:uncultivated organism with predicted taxonomy:Coraliomargarita sp. CAG:312
  REGION 1..1062: note = MG1-238 effector

SEQ ID NO: 234 - protein, 1061 aa, unidentified; identical to SEQ ID NO: 131
  REGION 1..1061: note = Description of Unknown:uncultivated organism with predicted taxonomy: unclassifiedVerrucomicrobia (miscellaneous)
  REGION 1..1061: note = MG1-239 effector

SEQ ID NO: 235 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-240 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLNEL

SEQ ID NO: 236 - protein, 1062 aa, unidentified; identical to SEQ ID NO: 81
  REGION 1..1062: note = Description of Unknown:uncultivated organism with predicted taxonomy: Verrucomicrobia
  REGION 1..1062: note = MG1-241 effector

SEQ ID NO: 237 - protein, 1062 aa, unidentified
  REGION 1..1062: note = Description of Unknown:uncultivated organism with predicted taxonomy:Coraliomargarita sp. CAG:312
  REGION 1..1062: note = MG1-242 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 238 - protein, 1074 aa, unidentified; identical to SEQ ID NO: 151
  REGION 1..1074: note = Description of Unknown:uncultivated organism with predicted taxonomy: Verrucomicrobia
  REGION 1..1074: note = MG1-243 effector

SEQ ID NO: 239 - protein, 1059 aa, unidentified; identical to SEQ ID NO: 96
  REGION 1..1059: note = Description of Unknown:uncultivated organism with predicted taxonomy: unclassifiedVerrucomicrobia (miscellaneous)
  REGION 1..1059: note = MG1-244 effector

SEQ ID NO: 240 - protein, 1062 aa, unidentified; identical to SEQ ID NO: 97
  REGION 1..1062: note = Description of Unknown:uncultivated organism with predicted taxonomy:Coraliomargarita sp. CAG:312
  REGION 1..1062: note = MG1-245 effector

SEQ ID NO: 241 - protein, 1061 aa, unidentified
  REGION 1..1061: note = Description of Unknown:uncultivated organism with predicted taxonomy: unclassifiedVerrucomicrobia (miscellaneous)
  REGION 1..1061: note = MG1-246 effector
MKVMEAENRNHIWGFDIGKGSLGEAVLMGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPTEFYAKKAGEISNADPNKGIVASDLDFIKLMGNCGWSGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 242 - protein, 1062 aa, unidentified
  REGION 1..1062: note = Description of Unknown:uncultivated organism with predicted taxonomy:Coraliomargarita sp. CAG:312
  REGION 1..1062: note = MG1-247 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 243 - protein, 1034 aa, unidentified; identical to SEQ ID NO: 147
  REGION 1..1034: note = Description of Unknown:uncultivated organism with predicted taxonomy: unclassifiedVerrucomicrobia (miscellaneous)
  REGION 1..1034: note = MG1-248 effector

SEQ ID NO: 244 - protein, 1059 aa, unidentified; identical to SEQ ID NO: 149
  REGION 1..1059: note = Description of Unknown:uncultivated organism with predicted taxonomy: unclassifiedVerrucomicrobia (miscellaneous)
  REGION 1..1059: note = MG1-249 effector

SEQ ID NO: 245 - protein, 1062 aa, unidentified; identical to SEQ ID NO: 158
  REGION 1..1062: note = Description of Unknown:uncultivated organism with predicted taxonomy:Coraliomargarita sp. CAG:312
  REGION 1..1062: note = MG1-250 effector

SEQ ID NO: 246 - protein, 1062 aa, unidentified; identical to SEQ ID NO: 184
  REGION 1..1062: note = Description of Unknown:uncultivated organism with predicted taxonomy:Coraliomargarita sp. CAG:312
  REGION 1..1062: note = MG1-251 effector

SEQ ID NO: 247 - protein, 1060 aa, unidentified; identical to SEQ ID NO: 139
  REGION 1..1060: note = Description of Unknown:uncultivated organism with predicted taxonomy: unclassifiedVerrucomicrobia (miscellaneous)
  REGION 1..1060: note = MG1-252 effector

SEQ ID NO: 248 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-253 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGREISEISNTDKNKGVVSSDLDFIKLMGDCPWGGIFIPADLTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 249 - protein, 1059 aa, unidentified; identical to SEQ ID NO: 136
  REGION 1..1059: note = Description of Unknown:uncultivated organism with predicted taxonomy: unclassifiedVerrucomicrobia (miscellaneous)
  REGION 1..1059: note = MG1-254 effector

SEQ ID NO: 250 - protein, 1059 aa, unidentified; identical to SEQ ID NO: 134
  REGION 1..1059: note = Description of Unknown:uncultivated organism with predicted taxonomy: unclassifiedVerrucomicrobia (miscellaneous)
  REGION 1..1059: note = MG1-255 effector

SEQ ID NO: 251 - protein, 1059 aa, unidentified; identical to SEQ ID NO: 119
  REGION 1..1059: note = Description of Unknown:uncultivated organism with predicted taxonomy: unclassifiedVerrucomicrobia (miscellaneous)
  REGION 1..1059: note = MG1-256 effector

SEQ ID NO: 252 - protein, 1059 aa, unidentified; identical to SEQ ID NO: 143
  REGION 1..1059: note = Description of Unknown:uncultivated organism with predicted taxonomy: unclassifiedVerrucomicrobia (miscellaneous)
  REGION 1..1059: note = MG1-257 effector

SEQ ID NO: 253 - protein, 1074 aa, unidentified; identical to SEQ ID NO: 157
  REGION 1..1074: note = Description of Unknown:uncultivated organism with predicted taxonomy: Verrucomicrobia
  REGION 1..1074: note = MG1-258 effector

SEQ ID NO: 254 - protein, 1059 aa, unidentified; identical to SEQ ID NO: 161
  REGION 1..1059: note = Description of Unknown:uncultivated organism with predicted taxonomy: unclassifiedVerrucomicrobia (miscellaneous)
  REGION 1..1059: note = MG1-259 effector

SEQ ID NO: 255 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-260 effector
MEKEKNNHVWGFDIGKGSLGEAVRIGGDFKHIASVLLDPEFGEIKTAALACRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 256 - protein, 1059 aa, unidentified; identical to SEQ ID NO: 94
  REGION 1..1059: note = Description of Unknown:uncultivated organism with predicted taxonomy: unclassifiedVerrucomicrobia (miscellaneous)
  REGION 1..1059: note = MG1-261 effector

SEQ ID NO: 257 - protein, 1061 aa, unidentified
  REGION 1..1061: note = Description of Unknown:uncultivated organism with predicted taxonomy: unclassifiedVerrucomicrobia (miscellaneous)
  REGION 1..1061: note = MG1-262 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 258 - protein, 1055 aa, unidentified; identical to SEQ ID NO: 153
  REGION 1..1055: note = Description of Unknown:uncultivated organism with predicted taxonomy: Verrucomicrobia
  REGION 1..1055: note = MG1-263 effector

SEQ ID NO: 259 - protein, 1075 aa, unidentified
  REGION 1..1075: note = Description of Unknown:uncultivated organism with predicted taxonomy: unclassifiedVerrucomicrobia (miscellaneous)
  REGION 1..1075: note = MG1-264 effector
MSLYFIEQISDWKIMKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 260 - protein, 1063 aa, unidentified; identical to SEQ ID NO: 159
  REGION 1..1063: note = Description of Unknown:uncultivated organism with predicted taxonomy: unclassifiedVerrucomicrobia (miscellaneous)
  REGION 1..1063: note = MG1-265 effector

SEQ ID NO: 261 - protein, 1022 aa, unidentified
  REGION 1..1022: note = Description of Unknown:uncultivated organism with predicted taxonomy:Coraliomargarita sp. CAG:312
  REGION 1..1022: note = MG1-266 effector
NNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMIN

SEQ ID NO: 262 - protein, 1073 aa, unidentified
  REGION 1..1073: note = Description of Unknown:uncultivated organism with predicted taxonomy: Verrucomicrobia
  REGION 1..1073: note = MG1-267 effector
MHTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATELGKIANTDKNKGLVAGDLDFLKLMSDAPWSGIFIPDVGLSDFADTSEAARAAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 263 - protein, 1059 aa, unidentified; identical to SEQ ID NO: 100
  REGION 1..1059: note = Description of Unknown:uncultivated organism with predicted taxonomy: Verrucomicrobia
  REGION 1..1059: note = MG1-268 effector

SEQ ID NO: 264 - protein, 1078 aa, unidentified
  REGION 1..1078: note = Description of Unknown:uncultivated organism with predicted taxonomy: unclassifiedVerrucomicrobia (miscellaneous)
  REGION 1..1078: note = MG1-269 effector
VDFCSHCKYFNNNKEFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPELKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 265 - protein, 1055 aa, unidentified; identical to SEQ ID NO: 98
  REGION 1..1055: note = Description of Unknown:uncultivated organism with predicted taxonomy: Verrucomicrobia
  REGION 1..1055: note = MG1-270 effector

SEQ ID NO: 266 - protein, 1059 aa, unidentified
  REGION 1..1059: note = Description of Unknown:uncultivated organism with predicted taxonomy: unclassifiedVerrucomicrobia (miscellaneous)
  REGION 1..1059: note = MG1-271 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLFNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 267 - protein, 1273 aa, unidentified
  REGION 1..1273: note = Description of Unknown:uncultivated organism
  REGION 1..1273: note = MG1-272 effector
MKDYVLKAANQSPTNNDSFLTGLVFGFDVGTGSIGYAVRKKDKFLDAGVLICPEGINDLSGRNGLRRGRRTLDHRQNRRDWFAENLAKVLGLSLHKGTRLPNTAWTQNEKAGWIPVSPKFANPVSLRIDALGGKPLTAEQLFTALAHLIKHRGPSEKVPWSKTIAEEQRDLDEKESVSDTIPADQVRAEFEKARKEFTLSNADASGFHPAHYLQQLGEERKLQRKRAWPRDLVETEAAAILEAQANHHQKLKEEIKFVDVSGENRKATVAEWLLHGNSSIKSVREGDAEMSFHVFDRNYPNRERAPFTFQAARIHNRKPGLDLVEPRDEFGRPRYVMSRERPEYGQWQVEVALLNFKVLDLTSLKKDKAKIVPSAEALAELREIITRTGRLSVEDLQTWIKPYKENGIYDLVKEQPALVGEGKGRGRFSRVGLQRATEIIRPLQTEHNAMSKLTPKGQRAKKKLKTPEDKADAYVRQYVNYTPKLRYAWKNPATQITEPEPLPRALRRYILEIRDPVVRHRVELFDRMLDDLLGKYRSDGNPTHIVIECVRELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKLQRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHKQVFDSGLYGKRTTYGGKPLEKDEPVFFVIAKQLSRLTPAVLSYPAKGGGDSIFSPKLREHIASAWKTYTADNANWQHLLTRSEEDLQRELQDAENSKDNQYKFKTIKALKDRLRRVSQWRVAIPNETLWAELQEYLQQEKARRLKKPEARNNVFPDHFIEGLRHPNYNTPIHSVKVIALTKDEDAYVELRTGSKTFWKYKGGYEAMRVYGSPPKTRTGKGKFICWLVRRFYKRKKKENGQLQTVKEAHAAAMPAVCQGQKLLATFHNGQVVRFKQLAKDMDISHNWIICETNADTRNPRNSKIVVMPAHLAKIVADPENPKRTISLKETEGVPLFL

SEQ ID NO: 268 - protein, 992 aa, unidentified
  REGION 1..992: note = Description of Unknown:uncultivated organism with predicted taxonomy: Rhizobiales
  REGION 1..992: note = MG1-273 effector
MDKTDYVLKNKPEPASNDKFLTGLVFGFDVGTGSIGYAVRKGSEFKDVGVLICDSEGSELEGRRNLRRQRRTIRSRKSRREWFARELVKLGLPKSETALDDPISLRLRALNGEVLKPEELHAALTHLFKRRGYTKVPWANVEAVRKDGEKAKKEEGDTQKAISELEQEMKNAGCDYPCQLLDQRRKKLGERPQTKWGRNFPWGRATLEKEFWKIVEAQKEHCPELAKNAEKLLHGNTHKVTRIIDGQKREFHVYFKTDKEHKAGVLGVRWPKFENRSPGLDALEPFRKDPKTGAWIPQHTMRRDNLLFKEWQLEKSLHDFRVKRRMISSGRSKKEKFEFIPPPPAALAALRKLWNERGHLWAADLQEWAKAYEGQFELHYPDRDLTPRNNFSGRARFSKIGMASIRKVIDEARVRHDVAYEAWELKFKEKNKEAKEEDIFNGYARFLTQQSNAPVLAAGVADNSYARTVAPPPVLILPGETPEAAFQRYLNAIRDPQVRHRVELFGRELRRLMTLHSQNQAPDFIVIEMARDLMMNQEQKDAKEAKDKERRKERDEAAQILRDMGFAPDADNIKKFLLAQEAGWRCPFTLRPFCQSDFSQLTVTQLIQAENKPRFVKEASSVFDRLEIEHLVPRTPVVCNEWFNLTVTLHSTNAQKRKRTPFQWLFADKDGLPADLDWERIRKNAVERFGESSLKYQVFTSPDGAKLVEDNAKKSIQQTAYIARCLREACLIIFGKEWLDWTDGAGRDPRLLTDNRASKNYLTTNGVITSRLRGAWHLNEVLWPKPERLNDTEWDKLTDDEKIPLKAKYKEERELRALKNRQDHRHHAIDAMVISCAMPWQTCKTRTGSQQSDDGLCEVDSETGAITKIWNPVFNDYGYGIKQAAEAKSALLLKFSSERQVDLLRHHKSNNRNAQAFDTTIYGRRENFGGEILPQTLFVARKRLLDLKVSHLDPRGKGGFIFSKLLRDHIEKEWKLFSGDEKNWLRVQSDWM

SEQ ID NO: 269 - protein, 1258 aa, unidentified
  REGION 1..1258: note = Description of Unknown:uncultivated organism
  REGION 1..1258: note = MG1-274 effector
MPKENESSFLNGLVFGFDVGTGSIGYAVRKGAEFLDVGVLICDSKGSDLSKRRELRRQRRTLRSRKYRRQWLANELSELGLTKPVPSPDDPVSLRLRALNGEALKPEELHAALTHLFKRRGYSKVPWAKVEALRKNGEKAKQEDSDTQKGITELEQEMNEKGCTYPCQLLDLRRKDAGTLPKRKWGRNFPWGRQMLETEFRAIAEAQKDHFPELVQNVESLLHRNTLEIRREVDGKKQTFHVFFKTDTGKKPGVLGIRWPKFENRGPGLDALEPFRKDRKTGAWIPQHTLRRDSLFFKEWQSEVALRNFRVKRRLITVGRSKKEKFELIPPPPVALERLRNLWNEHGHLWAEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMRVYRLPKPGRSGAYACWLLLPWYGMLDARGKRFKTVEKDLMTRACKGAKFVRAFRRDDIVCFANNLLANKGIKQNESWRIVRTDAKGDCLANVGLLPANLARETSHPITGEKVKLEPVVVALNDFMNALEPRLPTDELSHSPPVKPKSPGAAET

SEQ ID NO: 270 - protein, 1260 aa, unidentified
  REGION 1..1260: note = Description of Unknown:uncultivated organism
  REGION 1..1260: note = MG1-275 effector
VLISAQWKTISTNLSIMDYIIKPAPGSTSSPYDWANDPFYKSAIVLGIDIGIEGIGVWLRKGRNHVFARTFLFNTPEAAPLKGRRLLRGGRRCRQSEQHREVLLKQFCAEFGLPWTEIKDQENEDGPFKLRLRAVRSKLGSKEALVVCLRHIIRHRGYDYHETDGGSFPWGDELKADVATGWAKAAYCSPEDAAEFLHDVSDCGWNDKQLASFRHALTAAVERHKQGIEAALEKHFAQDKNNLRIPARKHNFPRSLIWKHMEKICANHRDFLGGEAGLSAALLKLKPILNYHRKKPGALAERKVNRCPVAIHLFGGTAPKCDPNSNPHIRRFKLLEFLATRSFVAKDGTRLLANADLMKWLLDEVLAEDIRAVVVNKVKGGQKQERRKFGGFRDEFIARFDPNGKIELAGDRVSHNKDFFEQLGDLLRPKLSVLNARASICGKSAEELFKRATKDGYQAEIISRNLKEKQFDGQSFYTLRQAAAAGFGIYPQVEFLLGRRGKKGNQAVPGVLRQMLELPEVSAKLDGQKIPDYVIIETVGDMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIAQLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNRSKKSRFQQWIYGFPDKNGQMWARDSLKSLADKANLLELLRDAGIGENQLPTSHFEEWQEKRKAQFFTREEAWAAVEALALPPEQKIPEPIFEEWWSYRFSGDKRKVDEKLLRILIAKAGVKESVSKERLASVLTNRGDPGPLTRKDGTPINGVSGTAKQMTPMAIIPHRNHKREIIGFKLATESFVRAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 271 - protein, 780 aa, unidentified
  REGION 1..780: note = Description of Unknown:uncultivated organism with predicted taxonomy: Verrucomicrobiabacterium IMCC26134
  REGION 1..780: note = MG1-276 effector
LFGPPARAYASFFVEERKRHGLREGSASDWQGVLSQKIPRFDNRIIGKCVLIPRLNVCKIRTGPDGGLLPQSRVAAEVVFLMKLKNMRLHRDGGARGLTAAEIGKILGDPKRSKLGLTPTQWKKWCVRFGGLPLPGQYEEVEEPRFSGRSRFCRPALEILRRLILSGDAPPLAHEKEVARLNGNTDPLKGLVPDDLRFLKQMGSTWEGIYVPNQKLDALARLTDDPQEAIRRLIGSQNDPIVRHRLALFAKRLDYLAVTKKFGPPDYVVLEFVREDFMGQKAKLEYLKFQRERARARAEAREEAAKAGATENSAGLKMELHKAQGGICLYTGDGLAVTSLDDYDIDHIVPESQGGPDALLNKVLTTRLANREKANRTPYEWLASSDRWDAYVERGKKRLTTLRNKKVQLLTSPEATALVEKYTALAETAWISKLAQTIVGLRFGWPGGIVDGKRKVIVVSGGLTGRIRRKYKLNRLLNPNASSEEEAETKNRDDDRHHALDAMVISFIPNWTRNAKLAGFFRFPEGVHGEFFANEIADVVPKNVALEKAAFEETCYGRRTLQGEQFAVGREDLSGLAVRLVGAKRVLKKRADIETHRIVDARIRSDVEAFLDANVGLTLEAWGAWCSTYKQGGNGPRVAKVMVTKSKADSLEEYKDVSKDGTGQLRRGAKHRGYFVYEHLAATKKDPDRKQLEVRPVYVHESKKAVAAGITGRIYAYFESGCLVRLAKPWVFQGKPYPPGQYICTSIWANRNAKLRHPEYGDIGPVGLRLLLDAGFERVE

SEQ ID NO: 272 - protein, 1068 aa, unidentified
  REGION 1..1068: note = Description of Unknown:uncultivated organism
  REGION 1..1068: note = MG1-277 effector
MKDYVLKNKPEPASNDKFLTGLVFGFDVGTGSIGYAVRRGADFKDVGVLICDSEGSDLSKRRDLRRQRRTLRSKKFRRQWFAKELAKLGLPKSQTALDDPISLRLRALNGEALKPEELHAALTHLFKRRGYSAVPWAKETKETVKPKTEDDDGEILKQAHGLKAEMDKRGCKHPCQYLAQRRKEVGESPTDYWGRKLYWLRELLEAEFRAITEAQQKYFPQLAEKSDWLLYGDSQPKKTKDEETFHVFFKATEARSPGVLGLRWPRFDNRGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPNGKKFITQFVRPWVRKGIAEQSSIPEGSKHICTLTKGDILVMKNADLEKKIEAGTRWILKKTFSSGRVSILPSHLSPNREVLISLGFDPINFLRISMNDLMRVLGHELPHPPSVKPQSESSD

SEQ ID NO: 273 - protein, 788 aa, unidentified
  REGION 1..788: note = Description of Unknown:uncultivated organism with predicted taxonomy: Pedosphaera sp.Tous-C6FEB
  REGION 1..788: note = MG1-278 effector
MKSAKPQPMKTIWAFDLGKGSIGEAVRLDDKFPHAESLLIPAELARRGPATVSGTPANRYRALKTREAHHERERWLETVWKSAGLIPLYPREVWENPNTGKWELKRNGDHRLEREFAPKLGEKTKDGAPSDEAGAEVCYTSCLLRINLLQGNKLADWQIFKALRAALQCRGYGPVPWATKEARKQGRTAEEIQLEEEKKLQQADARYRDAVGKWPEFKRSVPAQFHFACYYDASKIGLWDVSNPNIFLHRANHLAASTRNVRFDRVDVRAEMIKLGDQAAAILPELRIAFARWQKDGWKFRHPNGKELTYPVRAKTFGEFLCDGPAGKPDETSFEAFLSQRRDVKVQRGSYEEWMAALGQKTPSFDNRILNICVLIPRFHVCKVDVRLETQKDENKKDKFTGNIVPESLLASEVTFLLKLKNLLVADGQRKLTAGEIQFVFNYAHRQLKELKLVTPGGELIKNWPGKIADCFALSKSEWGGKKSLSKLALRPLPGHEEVKAPKTSGRSAYSRVALRILKELILSGEAPSVFHAKLLRRDADLLRRLGSNSDRPLVLFDDSVAKDEKQRERENNENRKHVVLVSEVHFLCQMRKDNSAADSWENIFIPSQTLDALQQRHTNDGKLDADDAIQELLGTINDPIVRHRLGVFAGRLKKLQHGDGKEETPKCGVPDFIVLEFAREDFMGEEAVKKYQRFLNDRADERKKAREEAEKLGLESRSSGLRYELFKAQGGICLYTGKSLGETSLDDYEIDHIVPRSLGVPDAALNYVLTFHDVNHAKEKGKLTPYA

SEQ ID NO: 274 - protein, 1024 aa, unidentified
  REGION 1..1024: note = Description of Unknown:uncultivated organism
  REGION 1..1024: note = MG1-279 effector
MKDYVLKNKPEPASNDKFLTGLVFGFDVGTGSIGYAVRKGADFKDVGVLICDSEGSDLSKRRDLRRQRRTLRSKRFRRQWFAKELVKLGLPKSETALDDPISLRLRALNGEELKPEELHAALTHLFKRRGYSKVPWANEAKIVKETAKSKKDDDEGIIKEAVKEMKAKLGDKHPCQFLAEEKARVGNSPTTNWARKIYWPREVLRAEFLAILKAQQNNFPQLAEKADWLLYGDSQAKEKNGETFHVFFKSTEARNPGVLGLRWPRFDNRGPALDSLQPVDGQGRPLHVVRKNKEAFGNAQWELALMNFRVLDVETRQKRDPRTDFPIFIENVRNEWNKKGKVTEARLKTLAKPFKDKFLLIKDQKPLTPDHGGGRARYSSPTLDLIHKEISEGRRVDPPQPILQRKGENAEQALNRYLADVKHPVVQHRLVLFRRLLMQLVSRYGQPDMIVLEAVRSLALGQKAKNELNQRNEKFRKERENAREQLSSNKESFSRKAIQRYRLWQEAKGRCPFCLQMIERTELGHGADIEHLVPRSIVDCNEFYNLTVAHIKCNRELKGDRTPFAAFSGTSQWPDIKDHAEKTFFGRKLEIFLSPDAEQLIEQKSDLQHTAYIARVIRHISLIQLGWLNDAGRDPTPEKQNPALSFQVTNGQLTSRLRKSWGLNQILHPLPPGKRWDELTDEEQTQFTEKNRGDLRHHSLDAMVIACTLPWLAHRTHGATDQFGHHGWWTQDEKQRSKAANPLFPNEGQMHDVVKKEIEKVIVRHHVSRSNHKRTYDTTIYGKKSSNVYVAREKLTDLKEKDFESVYPKIFGVYIAAAWERFTTETPGLPEMLKATKNKLPEMFARKLCFSHFQNWREKKPVAFDWPDKVRIPIRSVKYIGVHDDKAVAKASSGTHGYVARGGYKEVRIHKTTDGKGWVPVFVPYWKGDRLIHEQPFQAEKPVQTIRLGDLIELKNGYGPNNPPGTYRVVSTMQKQIQLMPPNIADTKEALKASGYLENGINLRWPAFFKAAGYELPHPPSVKP

SEQ ID NO: 275 - protein, 1214 aa, unidentified
  REGION 1..1214: note = Description of Unknown:uncultivated organism
  REGION 1..1214: note = MG1-280 effector
KVLGLSLHKGTRLPNTAWTQNEKAGWIPVSPKFANPVSLRIDALGGKPLTAEQLFTALAHLIKHRGPSEKVPWSKTIAEEQRDLDEKESVSDTIPADQVRAEFEKARKEFTLSNADASGFHPAHYLQQLGEERKLQRKRAWPRDLVETEAAAILEAQANHHQKLKEEIKFVDVSGENRKATVAEWLLHGNSSIKSVREGDAEMSFHVFDRNYPNRERAPFTFQAARIHNRKPGLDLVEPRDEFGRPRYVMSRERPEYGQWQVEVALLNFKVLDLTSLKKDKAKIVPSAEALAELREIITRTGRLSVEDLQTWIKPYKENGIYDLVKEQPALVGEGKGRGRFSRVGLQRATEIIRPLQTEHNAMSKLTPKGQRAKKKLKTPEDKADAYVRQYVNYTPKLRYAWKNPATQITEPEPLPRALRRYILEIRDPVVRHRVELFDRMLDDLLGKYRSDGNPTHIVIECVRELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKLQRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHKQVFDSGLYGKRTTYGGKPLEKDEPVFFVIAKQLSRLTPAVLSYPAKGGGDSIFSPKLREHIASAWKTYTADNANWQHLLTRSEEDLQRELQDAENSKDNQYKFKTIKALKDRLRRVSQWRVAIPNETLWAELQEYLQQEKARRLKKPEARNNVFPDHFIEGLRHPNYNTPIHSVKVIALTKDEDAYVELRTGSKTFWKYKGGYEAMRVYGSPPKTRTGKGKFICWLVRRFYKRKKKENGQLQTVKEAHAAAMPAVCQGQKLLATFHNGQVVRFKQLAKDMDISHNWIICETNADTRNPRNSKIVVMPAHLAKIVADPENPKRTISLKETEGVPLFLNEFMWALGYETPTKDNELPHPTSVKPQS

SEQ ID NO: 276 - protein, 837 aa, unidentified
  REGION 1..837: note = Description of Unknown:uncultivated organism with predicted taxonomy:Thermoflexibacter ruber
  REGION 1..837: note = MG1-281 effector
ESPTDYWGRKLYWLRELLEAEFRAITEAQQKYFPQLAEKSDWLLYGDSQPKKTKDEETFHVFFKATEARSPGVLGLRWPRFDNPGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPNGKKFITQFVRPWVRKGIAEQSSIPEGSKHICTLTKGDILVMKNADLEKKIEAGTRWILKKTFSSGRVSILPSHLSP

SEQ ID NO: 277 - protein, 947 aa, unidentified
  REGION 1..947: note = Description of Unknown:uncultivated organism
  REGION 1..947: note = MG1-282 effector
MKDYVLKNKPEPASNDKFLTGLVFGFDVGTGSIGYAVRRGADFKDVGVLICDSEGSDLSKRRDLRRQRRTLRSKKFRRQWFAKELAKLGLPKSQTALDDPISLRLRALNGEALKPEELHAALTHLFKRRGYSAVPWAKETKETVKPKTEDDDGEILKQAHGLKAEMDKRGCKHPCQYLAQRRKEVGESPTDYWGRKLYWLRELLEAEFRAITEAQQKYFPQLAEKSDWLLYGDSQPKKTKDEETFHVFFKATEARSPGVLGLRWPRFDNRGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPN

SEQ ID NO: 278 - protein, 1319 aa, unidentified
  REGION 1..1319: note = Description of Unknown:uncultivated organism with predicted taxonomy: Verrucomicrobiabacterium IMCC26134
  REGION 1..1319: note = MG1-283 effector
MDKTNYVLKNKPEPAANETVWAFDLGKGSIGEAVRRGNEFLHKASLLIPAELARRGPAKVSGTPANRHRALKTREAHYERERWLETVWRTAKVTSLLTPLRPREVWENPETHKWELKHPADYQLEREFAPAEFRRNSKTGEKEKIVYPNGHAENDGAPASTSEDFNLCYTSCLLRIKLLNGDSDLKAWQIYKALRAAIQCRGYGKVPWAAKEARKQGKTAEELELEEEKKLLQADPRYREAVGRWPDFKRSIQKLKLPLFDGMQPRKADNFYFVPPCYYDASKMGLWNPSAPDKLLSHSNLANSTRNVRFDRFDVRNELIMLGDQAAALLPEIRDAFARWQREGWKIKHPVTGKELTYPVHAKTFGEFFCDGPAGKPDETSFEAFLNQREKAGLHRGSFEEWMAALGQKTPSFDNRILNDCTLIPRFHVCKVDLKLETAKHGEITGKILSESLLASEVTLLLKLKNLLISDPVNGQRKLTVEEVRDVFAYAQRQLKALNLIAADGDLIKGWPEKVADRFALNNSDWEKIAAEAEFFRKMSAFNLSQGGENRRLTEVEIYSLLRAAADSKRKLEHELPDNLKTLFKAAKAEWKKAKVVADTTMLRPLTNHEIVKAPKTSGRSGYSRVALRIIKELILSGQAPSVFHARLLRRESKLLGKLGASPAKPLCLFADSTATSEEQRKKEDTENRKRGLLESELNFLLQMRKDDATEDSWKDISPPSQTIDALQQRHTKGNKLDADAAISELLGSINDPIVRHRLEVFDKRLKKFELGDVKESIPAFGVPDAIVLEFVREDFMGEKAKRELKDFQDKREAARKKAREKATAAGSEEKSAALKFELCEAQGFICLYCGQPFATTKLNECRIEHIVPTAQGGPDAMVNYVAAHDECNEAKGKQTPFQWWHHNTSGKAPTISWDGYKALVDKYATTLRNKKVQLLTREDAVELVGRYTALAETAWVSKLAQTIANLRFNWTNGYDQNRKKRVIVISGGVTARVRRKYGLDKLLYNKDTDAEVFAKKLKNRADKRHHALDAMVLTFVPQWARDPGKEGFFRFPAEFRDANGREDYEQIRKLFGDSIAKVMPRYLTYERPVLRDRAYGQRDNKTMMVQRTPLRELAYKPVQQKLVYDLTYAVDQIKDVRDERIKQELQKFIAASPEEPAWNVFCDRLGKGELESLPGIKVSKVSQNLNGDLSEYKDMSKDGCGAFRRRKERHRGQFVYLDEKGKPRVEVVRVFDSIAKVKTELGAKGQGIKIIGFFQSDCLVKIGKPVAHGTITLAPGTYQLNKIVKEGQGRVQVTSAGGEKSPAISLSKFLEAGFERVD

SEQ ID NO: 279 - protein, 1053 aa, unidentified
  REGION 1..1053: note = Description of Unknown:uncultivated organism
  REGION 1..1053: note = MG1-284 effector
MKFNISTNTDPFLTGLVFGFDVGTGSIGYAVRRGSTFLPDGVGVLICDSEGSKLDERRNFRRQRRTLRSKKFRRQWFAKELVKLGLPKPTKEQLKRANNETNEQFDQRTNPVSLRVRALNEPLEKWQLFIALTHLFKRRGYEKDVPWANKEKDTKANKENDAEEWGSGTVPPEKVQSEFDASGCKYPCEFLARNPKHQRRRVWPRVLLENEFHAIAKAQTENKNFPQLTEKTNWLLYGETKEVKGHHVYFKTTEAQNPGVLGLRWPRFDNRGPALDSLQPLDEQGRPLHVVRKNKETFRKAQWELALINFRVIDRATGNLVRPDDKSLTRLREIWESGKRKKKKESGSNAAESEIIKISEPVLKRWAKDFAGQYKLVDGQQPLTPQTGAGRARYSSPTLERIIAGEQFNPPQPLLRRKNESAEQALNRYMADIKHPLVRHRLTLFQKLLQQLVSRFGEPDMIVLEAIRSLAMGEKKRREHIQRIKENRDERESIRTELKKDNFSSSKNSILRYRLFKEAKGRCPFCLCPFCLQEVVYKEAEIEHIVPRSRVDCNEFYNLTVAHQECNKKKDSRTPWEAYGTTKDWEALRKNAEDCFGLGSLKYRLFTNPDAQNLVEEKSDLQHTAYIARVIRQVSLIQLGWLAEDGRDATGLKDPEMTAWRFQVTNGSLTSRLRKSWGLNQILNPFPSKDAWEAMTPEEQEKKKTEMQEKNRGDLRHHSLDAMVIACTLPWLAHRTHGAKDSFGRPGWWWLDEKKRSQASTPIFPKEGQMHEVVKKEIEKVLVRHHVSRSNHQQSYATTLYAKKAENKYVAREVFTSLTPKNLGNIWPDKFALYCEAAWRRYSDESANLEGELKKTKGNVPASFTNKLCFAHFQKWRADDCPEFYWPKEIKIPIRSVRLISVKDDTAVVPFSPGTHAYVKRTGFKEVQVFLAEDEKSFVPAFIPHWKSDKPICEKPIKADRKPIAVIRRGELVKLLKPTGPKNPPGAYRVSTTMQDNIQLIPAHIAKDKDALLASGFLANGVTISWKSFFAAVGYELPHPPSVKSQPPGAAEA

SEQ ID NO: 280 - protein, 1065 aa, unidentified
  REGION 1..1065: note = Description of Unknown:uncultivated organism with predicted taxonomy: Verrucomicrobia
  REGION 1..1065: note = MG1-285 effector
MITYELKKVALQNQTDEIVWAFDLGKGSIGEAVRRGNEFLHKASLLIPAEFAETRTARDRRRMFRTREAHKAREKWLCKVMHEAGIEILHGRNYDAAGNWKLGEPAEKRLEQEFPAPGDDTCYTSCLLRIKLLRGEKLEPWQVFKAFHSAIQRRGYDKDIPWKTRESRNPKAKDGDDDDAGTEKRMHDFELALEKMAPGKTAFHFPAYFDAHEMGLWSPDKPDGLKLRSDCHAKTTRNQIVPRKLVEAEIRQMVEGAAKHYPALADKADYLLYGIAQQSYASYKPELRQKFKLREGGATDWQGVVGQKIPRFENRIIAKCALIPRLNVCKLREGEKGQPHEKSLVAVEVAFLMKLKNLRVQRPGGNGWLSAEEIRGILEDPKRKDWKITESVWRKYCVRIGAGWLLGHEEVKSPRFSGRSRFCRPALEVLKRLILSGQKPSKFLQEEIVRLNGNKDPLKGLVEADLKFIGDMAAKNDAWEGIYIPNQQLDALVELSSDSAEAITTLIGRQNDPIVRHRLSVFYKGLRELEQTTKSRPDQVVLEFVREDFMGKKAKIEYFSFIKRRAEERIKAREEAANAGATEKSAGLKLELLRAQDGCCLYTNEGLVPSRLDEYQIDHIVPRSKGGPDAVVNYALTTQKANEAKADRTPYDWFHQEMPDKWDAYVNRVRSRATHLRNKKVQLLVALNAAELADKYTALAETAWIAKLAQAIVGLHFGWRNGVDESGNKRVTVISGGLTGRIRRKYALNQILNPNAKTEEEAEKKNRDDDRHHALDAMVISFIPSWVRDAMKEKFFRFPEPIHQNAKGFFEKEIQSVKPRNIALQKAAFEETIYGQRTIDGHKFIVGRESLASLAIKTTQNSQTIKKVSDIEFGRIVDARIQKDVKEFWESNPAATLESWKKWCADYRLGANGPLVNFVLVKKSKEDAVEEYKNVSKAGVSSERGQYKRGAKHRGYYIYERPAPTRKEPNKMQVEVCPVFVFQSKKAVQENLLKQTGIKMHGYFESGCQVRTQREWEFQGKKYPADEFILGSVWANRNAKFRHPIHQEIGPVGLRILLDAGFERI

SEQ ID NO: 281 - protein, 1294 aa, unidentified; identical to SEQ ID NO: 16
  REGION 1..1294: note = Description of Unknown:uncultivated organism with predicted taxonomy: Verrucomicrobia
  REGION 1..1294: note = MG1-287 effector

SEQ ID NO: 282 - protein, 1294 aa, unidentified; identical to SEQ ID NO: 16
  REGION 1..1294: note = Description of Unknown:uncultivated organism
  REGION 1..1294: note = MG1-288 effector

SEQ ID NO: 283 - protein, 808 aa, unidentified
  REGION 1..808: note = Description of Unknown:uncultivated organism with predicted taxonomy: Pedosphaera sp.Tous-C6FEB
  REGION 1..808: note = MG1-289 effector
VGNTQEHVWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENLFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELW

SEQ ID NO: 284 - protein, 1048 aa, unidentified
  REGION 1..1048: note = Description of Unknown:uncultivated organism with predicted taxonomy:Deltaproteobacteria bacterium RIFOXYA12_FULL_61_11
  REGION 1..1048: note = MG1-290 effector
MTETSVLNERFHHGLVIGLDVGTAGLGWAVRRGPDLLDLGVLVVPEKVGNLEERRTLRRMRRTIRSRRQRMQQLRAMLTEVGLPSPGANAELDSPAVLRLQALNGEPLRPEELHAALFHLWKHRGWLDAWWKKKTVERTADDEPELTAEQKTAQKEAKETAARIAGLLAAMKDRGCRFACHYLALKEGRWDRTMGCLPRPKPGQAIAPEGHKNLIFPRELLREEFLAIVEAQRERWPTLYVARERILYGAWGEDSHHPAPEAAGRQHRLHGGVWHQRQARFDNRKPGKCVACGVNNVCRADAPEFAEAQRAIVLGNYRVFSAVQGKAVPVGQAALPELADILAKHQAGLKELRALAKTGGYTPLEPGIKKKDQARDLLVQQWADRNGYELLPGQQLTARKLSDGRCAFCRPCLRAVRYEYERTGTIRTFQPLLRRPGESLASARARYVRELRNPLVRQRVEALDRLLDRLERDHGSPAVIVVEAVRSLGLGKKANDDLKKKQATQREEREAARQEAAEHHAAGSQAVLRFRLAKEVGKVCPYCHQPFHADLADAEIEHILPRALGGSDQQVNLTVAHTHCNHEKHDQLPHAAWGEADRWPCLERFAREHFKGLKLQLFLHQGNPEEALALLAPPADLTQTAYIARALRGLCLLRQNWLTPEGRDPSDQPGGPGQFFQLTNGYLTAGIRRCWGLDELLPSALDDEGGKNRHDLRHHALDAAVIACTLPWAAHQPLSRGGWREAPPFGSARREQWRTPFDHLRSQIRARVPDIVPTQKVGTSAKQKMMNTTAYGPRPQRDRKGKETTVLVTRVPLVQLKEKQLNDIYPQVLMRYIAAALSEFRRTHGDEHAFQQKAPNTGKLSPAFVATLHNPGTGRPIHKVHVLGKDPAACREVRPNVFVEYTDATAYLVYPDPKKGRTWAVYLVKPWEKLGQLRASFPTPVYVFQKKQLIEFPREVVVSATNKAQAGKYRFMSCNKNGNVRLCPAHIVQGKEGFLSAGLPYYGFELHIRHLMEALGYGASPPPPAEAGVAAHPRPEPPHPQRRRGRRA

SEQ ID NO: 285 - protein, 932 aa, unidentified
  REGION 1..932: note = Description of Unknown:uncultivated organism with predicted taxonomy: CandidatusTermititenax aidoneus
  REGION 1..932: note = MG1-291 effector
ERLLREFPKDGDNTIYTSCLLRIALLQGKKLDGWQIYKAVWSAIQHRGYDKNLPWITRIKRNIEEENEDDSGAKNESTMDEKENIEGVGNYYKYLKDNFGDNKEFWYPCYYEAHKIGIWSPANLNDLSVKIGTNPNSARNKGKDKNYAVIPRELIKKELEELLKKAAEQFHKIKGKEKYIIYGLAEKEYASYIDKTFYKYRGKNWEWQGLLGQKVPRFDNRIISKCALIPRLNVCKAGDQLNKEVTFLMKLKNTKYVSHAGEELSFTSEQINKLFEKYKEKAYITKTQLEKWIKTELNGYSHPVHIKIDKSKTSGRSRFCRPALLIIKEIILSGKSPHDIYKEKITNNIITDSNKGLINGDYYFLLNMPKEWEKFWIPDKRENFSKISENKRIEEIETTIGEINNPIVRHRLNIFCDRLKKLKQKFSEPKKIVIEFIREDFMGDKKRREYIKIMNQRRKAKDEAFNEIKDLVKGKQSLIKQLLLKEQGCKDIYSYETLIPSQLNDYEIDHIVPRSKGGSDAMYNKVLTKASNNQEKGNRIPFEWLSADKEKWNMFYKNVESFRLNWKKKELLLAKDPTLLIEKYTTLAETAYITKLTQKIAHLFFGWDWQTKGSHRKIIVQSGGYTSKIRKIFKLNALLYPEKTGDEIREIVETGKNRDNKRHHALDALVLSITPEIKYDEKKDADVYPVWFNPEYCKNALDKVNPTYIDFEKPVLAETIYGKRTVNENGEKKEYFISKMKTGLEKEWYLDVINAKKYSKDIFDSRINKDFTREIEKNPTQEEWEKFVNIYFKNNRPKKLSLIQSDSPEIFKEINSIKGQYFTDKREHQGQLVYKNEKKWKVEPVFVYESLYLKRKEYEKKYGKVYFFNSLCQVKTNKDISFGRSNQLLSKGFYILRTITEGGQVKLESNNGLEFVIALSILMEEAQMERVD

SEQ ID NO: 286 - protein, 983 aa, unidentified
  REGION 1..983: note = Description of Unknown:uncultivated organism with predicted taxonomy: CandidatusTermititenax aidoneus
  REGION 1..983: note = MG1-292 effector
ERLLREFPKDGDNTIYTSCLLRIALLQGKKLDGWQIYKAVWSAIQHRGYDEKNHWKNDDDSAENKKNVNEYIKYCKDNKFEEKYWLPCYVDAHRMGIWSPEDSNNLYRKRNNETNPAPARNKNHSKYHLVFPRSKVEEELKHLLSQAAKLFPKLAGKENYIVYGPGEVQYASMKKMEFSKYRGKEWDWQGLLGQKIPRFDNRMLNKCCCMSHFNVCRADDMLNQEVMFLMMLKNMRYHSKNKPDEMLTAEQIKELFNKFKDRLKFEKNEKDKVKNRKKEVIPKSLLRKWVIEKLNGEIHPAHSLIPMPNAGGRSRYCRPALEVIREVILSGKTPKQVYEECVAKNKIENPEQNSKKGRIQSDFDFLIKKGTSEKWENFYISDNRYELREMSADERKIEIEKTLNEINNPIVSHRLKWFKKELNKLAFGEPEKKNPGYGIPEKVVLEFARDEFMGKQAKEDYYKFIKEQTKERKIVVEELEKAGFSKPSGEMIRKMMLFRQQDGIDFYSMQNIKLSHLGEYEIDHVIPRSRGGSDAFYNIILTTNKNNSAKGDKTPYEWLGKGDIWDNISEKLKVNKKMGSKKKLLFMASSEEQYKLLIDKYTQLSQTAYISKLAQKVTALTFGWGMQTKDDNRNIVIATGGQTARIRSRFKLDRLLHSGMTDEEFEKALRNGEIEKKNRSNPRHHALDALVLSAVPEIRVDKNRKGKYDDIYPSWLTRDFCEKEVAHVYPKQIKFSKAQLAEVLYGKREVKKEDGLWYTYAITRQNEGTRIEDYYVKKSEKKSDIEDMEKLRNKILKKVNHIFSNDIRTDFKKKLEEKPTEEQWNDFIKNYKVNGTCPHRISVIGNPGVKGFKEKQPLPPNYKEIRPNSKQYYETKTGQKWSYTAQLICLNEKDEWEVHPVYAWDSLYERIKKAEQEFKKVVKFHSRQSVEIKNDCANGKIKKGIYILATIQNGNWGVLESQGEKIDASLNELMNIGEMWPII

SEQ ID NO: 287 - protein, 983 aa, unidentified; identical to SEQ ID NO: 286
  REGION 1..983: note = Description of Unknown:uncultivated organism with predicted taxonomy: Elusimicrobiabacterium HGW-Elusimicrobia-1
  REGION 1..983: note = MG1-293 effector

SEQ ID NO: 288 - protein, 1033 aa, unidentified
  REGION 1..1033: note = Description of Unknown:uncultivated organism with predicted taxonomy: Endomicrobiumproavitum
  REGION 1..1033: note = MG1-294 effector
MADEKLIYSFDLGSGSLGICVREGSNIKYLDSLLIDSEYASIKEVANRRRQIRTRLAHKARESWWIQQAQSAGIEVLSTKQPNKNNPNDKADVKMLKQFDKNDNQTIYSSLLLRIALLQGKKLEGWQIFKAVWSAMQRRGYEKVPWANDSDAEKNSKAVTEYEKKLENLFGDKKEYYYPCYYEAYIQGIWSPSEPSNFSKKLSNNPEPIRNKDKENMIVPNRELVYKELKDLLTQAAKQYPKLKGKEDFIIYGPSEEKNASYNNPKYKKYRGTNWDWQGLLGQKIPRFDNRIISKCKLIPRLNVCKANKKLNKEVTFLLMLKNMRFTKDGVTSCSLNHEQIRKLFETYKDNFSTKESRTNKALINSKKWKNYLEEIGAEANPNQKDIPQPKLCGRSKFCRPALNILHSLILSGKNPHDYYKELISVNNNTNPQKGLIKDDYKFLLNMPNDWNSISIQDTREEDKNLNEEERLYKIDRIISATQNRIARHRLLVLFEYLQKLKKQYGEPEKIVFEIAREDFAGEEKRKEYIDTQNKNTKNIELAVKLLKEANKQLNNRNILKARLLIEQNNVDLYEIDEHRKISITNIDDYEIDHIIPRSRGGSDSFSNFVITSINNNQTKLNRTPYEWFHQDKSFDAWNTYIKNIEGIKGLSKHKIKLLISDKAIELENKKTDLQATSQIEKEAQTIASLLFGWGINTKGDKKKILFFTGGNTADVRKNLNLNRLLHPALSDEEYNELKKKKDFKDKNRKNTKHHALDALVLSVLPEITMDKKSIENKPEFFNIKFCEEQLKKVYPIIIKQTKPKLRETIYSLKCRKENGKNLYYFVSRFEKNISMFKILSDAKKQVEKIFSLQIQKDFNDKLNDKNLTQEKWEKFLDEYTLNGRKIKKVSMIDSKSFKENDVFDINGNIKKIIGEYGQNKINGQWIKAKESHQGQIAFKENNKWKIVPIYVFESKYLKLKQYKEKYNDILFFKTGDLVELTKNYDEVKAGIYKLRTLKSSGTTKLTSLDTYEDIEKTISMFIEKCGMKLYKK

SEQ ID NO: 289 - protein, 1049 aa, unidentified
  REGION 1..1049: note = Description of Unknown:uncultivated organism with predicted taxonomy: Verrucomicrobiabacterium 12-59-8
  REGION 1..1049: note = MG1-295 effector
RLRMSEKSERLVFAFDVGTGSLGLAARRGNTMLEARSLLLDENYGKRDEQRKIIRAFRTRKAHLAREKYLQAVCEEVGIPVLKGRENSKKGDPRLEREFPRQGDSTVYNSALLRIMLLQGKKLEPWQVYKALHSAIQRRGFDKSVPWKNRPSNRKDSEEEDSKTAESASAYRQELIAAVGEDTQYQYPCYFAAYKMGLWDPKTHQLKQRINHHADTVRNYIIPRDLVVKELVDLLKAASRQFPRLEGREMRIIYGPSARAYASYYPDARAEYGLKEGGENDWQGLLGQKIPRFDNRLPAPCALIPRFNVARSNDIAIYEATFLMKLKNIRFYRDHLQNKDFNESSLTVEEIHQLLKEARQRAKEARQNGETEEHIAAAYSLNKTEWKKWLKKNCHAPISTHPCIEAPSSTGRSRYSRPAARLIRELVLSGQSPADFYKEAQDLCGKKGTPYYKLSKDDLVFLRYIKGEWQNIYIPVLPLSGDWSGKSTEMDLIREQIKKLIGAQRNVLVVHRIGLFYEQLERMISLYGVPDEIIMEFIREDFMGEEAKKKLQKFQNENRKAWDQARSQARELNLSGGGNVRKLRMLREQNFICPYTGDTLSENEVDTLEVEHIVPRARGGSDNQYNKVVTRTRTNREKGDHTPYEWLTQKEEFAAFCERVEKMGLSRKKKEILTAKDPFTLDQKWDSLAETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPKASLQETFYGTRLLEGSAGGKTVVVRTKITELGVTFNKFDQKKALKEAASIIDPFLKESIISALESRDFKLNEWQEWCQNFRHPRTEARVLKVQITAQKPDTKEYVNMAKEGEEDGFRGQYKLGAQHQGYFVYLEKDKKGNDIPKVRPVYAFHSHRKVEKELRAQGCDVIGFFQSQCLVEFKNDYEHGNIVIPAGKYILSTILSDGRFKLEGINDIPCPLKKIQDIRHSFRRVDGPDQ

SEQ ID NO: 290 - protein, 1089 aa, unidentified
  REGION 1..1089: note = Description of Unknown:uncultivated organism
  REGION 1..1089: note = MG1-296 effector
MNKIFSFDLGSGSIGECVREGKNILHLNSLLIDNDFASLAEVRKNRRAFRTRIAHKSREDWWRHCAKIGKLEILSTEQPSVKNPYAKPDKRMLTEFSKEGDNTIYTSCLLRIALLQGQKLESWQIYKAVWSALQHRGYDANVPWAKNIREIQKKKKEELTAKEKELLKDLEEENKASKLYSEKISVLPQEYQFPCYFEAYTLGLWNPNNPNNFIRNINCSTKNIRNKENREQIIIPRSFIQKELRQMLDNARKQYPNLPETDFILYGTPKKEYASYYKPAENKKYEREGILGQKIPRFDNRMISKCCCMPRFNVCKANDELSIEVRFLLALLNMRFTKGNTTTAQLSPEELKQIFEKYKGNLSNIKNDNVLVIKQAEWKKEIENKIGGKVNENQKAIPHPNTTGRTKYCRPALEVLKDLILSGKNPHDFYEEQIAKLNNTDPMKGIVKEDLSFLKLMPNKWEKIYIPDQREENKQLSFEEAQVKIEDIIKNITNAVVKHRLTMFYRRLTALTQQYGMPNKVVLELAREEFLGEDKRAQYIKTQNENRKDKDLAKEELMTVIKSADPSYQTKLLKVRLLREQHYKDVYDLTENCALSIQDIDDYDIDHIVPISCGGADSMVNKVLTKKELNETKKQNQTPYEMYFQNASAETWAKYLEHLKDVYGKNISKHLEKKYELLTSDKAIEIESKRNDLQATMYIEKYAQKITALFFGWGEQTKGDERHIFVCNGGLTAKLRKENGLDRLLWSEEEFYKLMASGKLDEKNRENKKHHALDALVISFADDLRTDPKTGRKLFPEFAQNNPAFFSEAMDKVFPKQLRKKAPPLRETIYALRCRKEKGVDKYYMVSRFNTELKTNFGDLKEASKQIDKIFDYQIKKDLQAKLADKPTKEEWLNFLENYKLLGKTPVYKVAMIASKAFSKEEVFDENGNKRHVIGEYKEMGKMKGQYLMPKEGNKGQIIFKQGKKWKVTPIYPFDSVTVKLKAAKQKYGKALFWSSGDTLILQNDIEGSEIYKEETKELVEYKNKKGKILTREKISSKEKTRPATLPKGKYKLNTLKTEGRIIITNLSSSKKYVTNLNIFIEGKVYKEK

SEQ ID NO: 291 - protein, 969 aa, unidentified
  REGION 1..969: note = Description of Unknown:uncultivated organism with predicted taxonomy: Verrucomicrobiabacterium 12-59-8
  REGION 1..969: note = MG1-297 effector
MSEKSERLVFAFDVGTGSLGLAARRGNTMLEARSLLLDENYGKRDEQRKIIRAFRTRKAHLAREKYLQAVCEEVGIPVLKGRENSKKGDPRLEREFPRQGDSTVYNSALLRIMLLQGKKLEPWQVYKALHSAIQRRGFDKSVPWKNRPSNRKDSEEEDSKTAESASAYRQELIAAVGEDTQYQYPCYFAAYKMGLWDPKTHQLKQRINHHADTVRNYIIPRDLVVKELVDLLKAASRQFPRLEGREMRIIYGPSARAYASYYPDARAEYGLKEGGENDWQGLLGQKIPRFDNRLPAPCALIPRFNVARSNDIAIYEATFLMKLKNIRFYRDHLQNKDFNESSLTVAEIHQLLKEARQRAKEARQNGETEEHIAAAYSLNKTEWKKWLKKNCHAPISTHPCIEAPSTTGRSRYSRPAARLIRELVLSGQSPADFYKEAQDLCGKKGTPYYKLSKDDLVFLRYIKGEWQNIYIPVLPLSGDWSGKSTEMDLIREQIKKLIGAQRNVLVVHRIGLFYEQLERMISLYGVPDEIIMEFIREDFMGEEAKEKPKKFQNENRKAWDQARSQARELNLSGGGNVRKLRMLREQNFICPYTGDTLSENEVDTLEVEHIVPRARGGSDNQYNKVVTRSQTNREKGDHTPYEWLTQKGEFAAFCERVEKMGLSRKKKEILTAKDPFTLDQKWDSLAETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPKALLAETFYGTRELNGKDGGKTVVIRTKIMELGVTFNKFDQMKALREASSIIDPFLRDAVSTALKSRDFKINEWQEWCRNFRHPRTGARVLKVQITAQKPDTKEYVNMAKEGEEDGFRGQYKLGDQHQGYFIYLEKDKKENDVPKVRPVYAFHSRRKVEEE

SEQ ID NO: 292 - protein, 1045 aa, unidentified
  REGION 1..1045: note = Description of Unknown:uncultivated organism
  REGION 1..1045: note = MG1-298 effector
MTKIFAFDLGSGSIGECVREEGKSPIHLNSLLIDSDFASLDLIRAQRRAFRTRLAHKARESWWIQIAQEAGLPIPAADIKKDKFGHYVFTADEKMLREFPKTNDETVYNSALLRIALIEGKKLEGWQIFKAVWSAFQHRGYETNNWKDEELSEEEKKAEQEEQKASELYKEKLSVLPKEYQLPCYYEAYKMGLLNPQTKQIVTRLKTSTGNARNKDGRGEQIIAPRNIVEKELRLLLKQAKKQYAALPDTEYILYGTNRKAHAGLKDHSARKFESEGLLGQKTPRFDNRIIAKCSLIPRLNVCKSKEPLSREVRFLLALKNFRFIKNGQVSAFDFEEINELFNMYKGRLLDKVHANYIDKRDIKNYLKSKQYEIFSEDVIPMPKDGGRSRFCRPALRILKELILSGKNPHDFYRESTENITNTDTTKGLVKEDYKFLLAMPNDWYKIHIPDFREEDKNLSQEERLAKIDNLLNSITNAVVRHRLIMLMHRIEYLHKIYGVPDYCIMEIGRDEFLSEEEKADLNRANKERQKNNKKAYEELKKYGLEISHDNMEKYKLCESQKWTDIYNVFDDKKKISPEDLPNYDIDHIVPVSSGGADSLANKVVTARHLNQSQKSNKTPYQWLFEDKIKWADFLENIKNAGIDKNSKKYLFLTAKDAVSQAKSLNDLQATRYIEKLAQKLISLYFGWGEQTTGDKRKMFVCTGGLTAKIRSQYGLNRLLHKDLSGEEFKKIVAEGKLDEKNRNNKRHHALDALVISFTRDIKYDNKGKPVLPDYACNPAFFADAIEKVFPVTIRSKKPALRETVYALRARQEGKELKYYMVSRFNTRIDELFKKISDAKDNVKKIFDLSVKKAFEDKLNTNPSQEEWEQFLKDFRVSGNPVYKISMINSKGFKKQDVLNPDGSFKNPIGEYRAMGKVKGQYLMPKEGNKGQIIYNNGRKWVVEQIYPFDSIVKKLKAAKEKYGKVLFWNTGITLCLPNTIKGSLITKDENKKQQSIPTDVKVSKYKLNTIKGTTVIITDLSSGLKYSASLTTLIEEGKAYKERS

SEQ ID NO: 293 - protein, 1097 aa, unidentified
  REGION 1..1097: note = Description of Unknown:uncultivated organism
  REGION 1..1097: note = MG1-299 effector
MNSTETVFAFDCGLASLGEAVRQGQSFPLVESWLIPDKFAETKSAAMRRRMMTTRDAHKERELWLLKTFEDLGIEVLRGKEVSKTPAGWSVTRKADPRLTREFPKPGDDTCYTSCLLRIKLLRGEKLAPWQIYKAIRSAIQKRGYDPDIPWKNREEKQQKKEEESAAVLFDETLLRKTVGDHPDWLYPCFLDAFRMGLWSPANPTQLGTRIDHKAQSTRKTIMLRALVEKELRDLLHQAAQQLPALAGKEEFVLYGPNGKYSSSSVRAGALAQKVPRFDNRIIDKCALIPRLNVCKVRMEGTHPHPASQIIFEITFLQKLKNMRVQGSSGIRGLAPAEIALAAFSQKNSLPSKAWAAFCEERGLYPAPAFKKLAFKDVAPVLPPEVFRSALLEKLASVSVLDSGKRVRNLTDDERSALLALMQKPRDSFSFTSSQWANFCEDLGASPLPGHEEIKPPKAAGRARFCRPAAHILKRLILSGQAPATFHAAEILNLGGSADPRKGLVAADLDFLLNMGDSWDAIRIPDGKLDAIACQYTDADEAIRKLIGSQNNPVVRHRLGVFAQRLRELERRFGVPDQVVLEFVREDFMGDKARMELKKFQNDRAKARAEARERVAELGISEKNSLRYELWKAQGGRCLYTDDPLAETELDNYHVDHIVPRAKGGPDSRLNYVLTLNQTNDDKDDRTPFEWLSCNPARWLAYVNRVESRLKAADGISRKTAQLLTLPNAVELAEKYTALAETAWISRLAQKIADLSFGWKNGIDAAGRKRTVVVSGGLTARIRRKYGLNRILNPGASSEEEAEKKNRSDKRHHALDAMTISFIPQWARDPGKTGFFRFPKAIRDNPLPFFQARIDAVVPRQLCYEKAPLAETIYGLRKTPEGNQVVKRTDLRDLAYQTVNMKTVFNIDSAVKNGIPKILDERIQSALLEFARLKPTEEEWNRFVADFTPFGSRVRRVRLVETALPPDTMGEFKNMSKDGTAMLRKPLKANKGQYVFTEPDGKIKVRPVYSFESPFQVRTLLLAEEPGRVIQGFYQTGCLVSLERDVEAGKHKIPKGVYRLSTIRADAFVGIFNTHGNLLGPVGIQHLLRSGFRRIDG

SEQ ID NO: 294 - protein, 1059 aa, unidentified
  REGION 1..1059: note = Description of Unknown:uncultivated organism
  REGION 1..1059: note = MG1-300 effector
MRPTESVFAFDCGLASLGEAVRQDLAFPHVESWLIPEDFAETKSAAGRRRMLVTRQAHKEREAWLRMTFQDLGIETLNGKEVAKTPQGWQEVKKADERLTREFPKPGDDTCYTSCLLRIKLLRGEKLAPWQIFKAIRSAIQKRGYDPDIPWKNRETEKKEEDKEKPAVTYDAETLQKIIGSNESWLYPCYFEAHQMGLWSPERPDHLEARITHMAGSTRKTVMFRSLVEKEVRALLQAAALQIPALKGKEESILYGPDGKYSSSSVREGVLSQKVPRFDNRIIDKCALIPRMNVCKIRMDGTKPHPASRVIFEVTFLQKLKNMRVQSAAGIRGLTHEEIELATVLQKNSAAPKAWAEFCDSRGLTPSPSCKKLVFKETTPTLPPDQFRAAILEKLKSVSVMDGQKMIRDLTGDETLAALELFQKPRESLGFTAAQWTSFCEDLGVSSIPGHEEVKPPKASGRARFCRPAAFILKRLILSGQSPKDLHVAEIKSLNGNTEPNKGLVPSDLDFLLKMGDSWVNIHIPDGKLDAISQQSGSPDEAIRKLIGSQNNPVVRHRLSVFAQRLLSLASRFGTPDHVVLEFVREDFMGEEAKKRYLKFMNDRAKSRAEAREKVAALGISDKNILRYELWKSQGCRCLYTDLPLEETKLDDYKVDHIVPRAQGGPDSRLNYALTHNATNDEKDDRTPYEWLSGDSVKWQAYLNRVNARLKAADGISRKTAQLLTLPNAAELAEKYTALAETAWISRLSQKIIDLTFGWSNGVDASGRKRSIIVSGGLTARIRRKYHLNHILNPDAETDEEAEKKNRKDKRHHALDAMTISFIPQWARDPDKTGFFRLPKEIRDNPLPFFAKRIDTVIPRQLCFEKSPLAETIYGTRSEDGVVQVVKRSDLRDLAYKTENMKTTFNMEFAKEKSIPRIVDERIRNALLHLVEKDLSEEEWNHAITQFAPFGSIVRRVKLIETTLSPGSMGEFKNMSKDGTPMLRKPKKANKGQFVYLEENGEIEVRPVYPFESTHQIKREILSGRKGRSIQGFYQTGCLVELTSEVRSGNTVIPPGVYR

SEQ ID NO: 295 - protein, 1098 aa, unidentified
  REGION 1..1098: note = Description of Unknown:uncultivated organism
  REGION 1..1098: note = MG1-301 effector
MKSKETVFAFDCGVASLGEAVRQGLDFPQVESWLIPDTFAETKTAAMRRRMMTTRDAHKEREMWLLNTFRDLGIEVLRGKEVSKTSAGWAVTRKADPRLTREFPKPGDDTCYTSCLLRIKLLRGEKLAPWQIYKAIRSATQKRGYDPDIPWKNREEKNQKKEEEETAAILFDEKLLRKTVGDNPDWLYPCYLDAFRMGLWNPARPNQLETRINHKAQSTRKTVMLRALVEKELRDLLRQAALQLPALAGREEFILYGPDGKYSSSSVRAGALSQKVPRFDNRIIDKCALIPRLNVCKIRMEGNHPHPASQIIFEITFLQKLKNMRVQGASDIRGLTPAEIALAAFSQKNALTPKVWASFCEDRGLHPAPAYKKLAFKDVSPVLPPETFRTALIEKLNAVSILDSNKRIRNLTEEEHAALLALFQKPRDSFSFSATQWSNFCEDLGVSPLPGHEEVKPPKAAGRARFCRPAAQILKRLILSGQAPAAFHAAEIHNLNGNVDPRKGLVASDLDFLLNMGDSWDAIRIPDGKLDAIANQCSSADEAIRKLIGSQNNPVVRHRLGVFSQRLRQLERRFGAPDHVVLEFVREDFMGEKARMELRNFQNRRAKARAEARERVAELGISEKNSLRYELFKAQGGRCLYTDDPLAETELDNYRVDHIVPRAKGGPDSRLNYALTLNQTNDDKGDRTPYEWLSGNPVRWQAYLNRVEARLKTTDGISRKTAQLLTLPNAVELAEKYTALAETAWISRLAQKIADLTFGWQNGVDAAGRKRTIIVSGGLTARIRRKYGLNRLLNPDASSEEEAEKKNRSDKRHHALDAMTISFIPQWARDPDKTGFFRFPKEIRDNSLPFFKARIDAVVPRQLCYEKAPLAETIYGLRKTPKENQIVKRTDLRDLAYQTVNMKTVYNIDYAVKTSIPKIMDDRIKSALLEFAQSKPPEEDWNRFVAQFAPFGSLVRRVRLVETALPPDSMGEFKNMSKDGTPMLRKPLKANKGQYVFVEPDGKIKVRPVYSFESPFQVQAHLLADNAGRTIQGFYQTGCLVELAKDTEAGKHKIPKGVYRLSTIRADAYVGIFNTSGNLLGPIGIQHLLPSGFKRIDG

SEQ ID NO: 296 - protein, 1098 aa, unidentified
  REGION 1..1098: note = Description of Unknown:uncultivated organism
  REGION 1..1098: note = MG1-302 effector
MKTPETVFAFDCGLASLGEAVRQGLEFPQLESWLIPDTFAETQTAALRRRMMTTRAAHKERELWLQKTFEDLGLEVLYGKEVSKTPAGWAVTREADPRLTREFPKPGDETWYTSCLLRIKLLRGEKLAPWQIYKAIRSAIQKRGYDPDIPWKNREEKQQQKEDKETAAVLFDEKLLRQTVGDNPEWLYPCYLDASRMGLWNPARPDQLETRQDHKAQSTRKTVMLRALVEKELRDLLRQAARQLPVLAGKEEFILYGPNGKYSSSAVRAGVLAQKVPRFDNRIIDKCALIPRLNVCKIRMADNRPHPASQIIFEITFLQKLKNMRVQGSGGIRGLTPAEIALATFSQKNALPPKAWTAFCEERGLHPDPAHKKLAFQDISPVLPPEAFRSALAAKLNGISIMDSGKRVRNLTEEERAALLALFQQPRDSYSFTSSKWADFCEDIGVASLPGHEEVKPPKAAGRARFCRPAAQILKRLILSGQAPAAFHAAEIRALNGNADPRQGLVASDLDFLLNMGDSWDAIRIPDGKLDAIASRCADADEAIRKLIGSQNNPVVRHRLGVFAQRLRELKRRFGEPDHVVLEFVREDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTALAETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEKAPLAETIYGLRKTPEGDQVVKRTDLRELAYQTVNMKTVYNIDYAVKTSIPKILDERIQSPLLEFARTKPTEEDWNRFVSGFAPFGSLVRRVRLAETALPPDSMGEFKNMSKDGTPMLRKRLKANKGQYVLVEPDGKILVRPVYSFESPFQVRAQLLAEKAGRTIQGFYQTGCLVELEKEVEAGKRILPKGIYRLSTVLADGRAWLFSHEGPLLPRLSLKPLLSAGFKRIDS

SEQ ID NO: 297 - protein, 1098 aa, unidentified
  REGION 1..1098: note = Description of Unknown:uncultivated organism
  REGION 1..1098: note = MG1-303 effector
MKTPETVFAFDCGLASLGEAVRQGLEFPQLESWLIPDTFAETQTAALRRRMMTTRAAHKERELWLQKPFEDLGLEVLYGKEVSKTPAGWAVTREADPRLTREFPKPGDETWYTSCLLRIKLLRGEKLAPWQIYKAIRSAIQKRGYDPDIPWKNREEKQQQKEDKETAAVLFDEKLLRQTVGDNPEWLYPCYLDASRMGLWNPARPDQLETRQDHKAQSTRKTVMLRALVEKELRDLLRQAARQLPVLAGKEEFILYGPNGKYSSSAVRAGVLAQKVPRFDNRIIDKCALIPRLNVCKIRMADNRPHPASQIIFEITFLQKLKNMRVQGSGGIRGLTPAEIALATFSQKNALPPKAWTAFCEERGLHPDPAHKKLAFQDISPVLPPEAFRSALAAKLNGISIMDSGKRVRNLTEEERAALLALFQQPRDSYSFTSSKWADFCEDIGVASLPGHEEVKPPKAAGRARFCRPAAQILKRLILSGQAPAAFHAAEIRALNGNADPRQGLVASDLDFLLNMGDSWDAIRIPDGKLDAIASRCADADEAIRKLIGSQNNPVVRHRLGVFAQRLRELKRRFGEPDHVVLEFVREDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTALAETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEKAPLAETIYGLRKTPEGDQVVKRTDLRELAYQTVNMKTVYNIDYAVKTSIPKILDERIQSPLLEFARTKPTEEDWNRFVSGFAPFGSLVRRVRLAETALPPDSMGEFKNMSKDGTPMLRKRLKANKGQYVLVEPDGKILVRPVYSFESPFQVRAQLLAEKAGRTIQGFYQTGCLVELEKEVEAGKRILPKGIYRLSTVLADGRAWLFSHEGPLLPRLSLKPLLSAGFKRIDS

SEQ ID NO: 298 - protein, 941 aa, unidentified
  REGION 1..941: note = Description of Unknown:uncultivated organism with predicted taxonomy: Verrucomicrobia
  REGION 1..941: note = MG1-304 effector
VRNDKDNSLEGQKRTQVYQDILKRNEDRRETARKALRASSLPDSDEMVVRWLLYQEQGPFCIYSGQPIRCSELPNLQIEHIVPRALGGPDAYWNWVLCKTDQNVEKGNRVPYQWFHEEKKSGEWEDYRRRVRNRATWLGSRKVDLLLRADAKELVGEKYTALAATSWIARITQSIVRLHFGWQLDDEPGKEKVMTISGGLTARIRRKYLLDSLLGTDKESQKVCEQVDQVLAEMEKLKSQPRSEETKVQWRELSQKRSQLARDSEKNRGDQRHHALDAMLLTFLPNWARDRNKEDFLRLEDIGDNAPYTDEGKRNAEKITDEIKKLVEETKPIYKQIKTARKANDFGEVDRLKHSIFPQRKRMAELFQSRDRLKQPRNIHKVRNWFREQLGGDRPVLPRPAAFKKVNIEATLYRCAYLIRNQTEPRRIPLPMLGRRPDFADDTQELFDLKWLRTRIQSITDADYDRAKLKALLGDRLKAAMSACLTHGHQFGEADWLAIVESKEVRELFSGKGRGKSKALPESADCQVKVFKVEMLPVKRYPLADLAYATGKTDVWNPVYFEDSISKILRRDESQPRGSRGKRRFQQIRPAPELPQGIASRWKGFFLDTDTQQKLKELQGEVAKIAALLPGPKPKKGETEKQNWEAADEKFGEALEEFRKKHDLPRKLFLFTSESDPPPKSPKTSLKRILFEPKDRIFSASVLKGQAADVVDLHFGRSLECFAESLLLVPDEQQRENLWKEFCNVVCIPTKKALQEFVAQKESISAKQWIDFFKSQDGPRVDQAEQEIGTLNEYCDLSKDGTGQFAKAGGMGGKPSYEGYFICKCKTDERIQAFPIRFFESKKTVRDRLNRSGWEMLDNSIWRSGELLHLKNKAVTKPKKQSQKPKEISSGYFMLGSIQKGTGVNLNACLGGEIPKAISLKILWDCGLRRASEPPHPSANV

SEQ ID NO: 299 - protein, 917 aa, unidentified
  REGION 1..917: note = Description of Unknown:uncultivated organism with predicted taxonomy: Verrucomicrobiabacterium IMCC26134
  REGION 1..917: note = MG1-305 effector
VFAFDCGVASLGEAVRRGLEFPQVESWLIPETFAETKTAAMRRRMMKTREAHTEREVWLLKTFEDLGIEVLCGKEVSKTPAGWTVTRKADSRLTREFPKPGDDTCYTSCLLRIKLLRGEKLAPWQIFKAIRSAIQKRGYDPDIPWKNREDAGQKKKDEESTAVLYDEHLLRKTVGDNPDWLYPCYLDAFRMGLWNPDRPEKLETRITHKAQSTRKTVMLRALVEKELRGLLRQAACQLPALAGKEEFILYGPDGKYSSSAVRAGALAQKVPRFDNRIIDKCALIPRLNVCKIRMEGNRPHPASQIIFETTFLQKLKNMRVQGSAGIRGLTAAEIALAAFTQRNSLPTKVWNAFCEERGLHPAPACKKLSFKDVSPALSPDVFRSALAEKLNGVAVMDSSKCVRNLTGEERASLLALFQKPRDSHSFTAAQWANFCEDLGVSPLPGHEEVKPPKASGRARFCRPAAQILKRLILSGQAPTTFHSAENRNIGVNADPRKGLVAADLDFLLNMGDSWDSLRIPDGKLDAIASQCSNADEAIRKLIGSQNNPVVRHRLGVFAQRLRELERRFGTPDQIVLEFVREDFMGDKARMELKKFQNDRAKARAEARERVAELGISEKNSLRYELWKAQGGRCLYMDDPLAETELDNYRIDHIVPRAKCGPDSRLNYALTLNQTNDDKGDRTPYEWLSGNPERWRAYLNRVEARLRAADGISRKTAQLLTLPNAVELAEKFTALAETAWISRLAQKIADLSFGWQNGVDAAGRKRTIVVSGGLTARIRRKYGLNRLLNPNATSEEEAEKKNRADKRHHALDAMTISFIPQWARDPDKTGFFRFPKEIRDNPHPFFQARIEAVVPRQLCYEKAPLAETIYGLRKTPEENQVVKRTDLRDLAYQTVDMKTVYKIDYAVKTGIPKIMDER

SEQ ID NO: 300 - protein, 1037 aa, unidentified
  REGION 1..1037: note = Description of Unknown:uncultivated organism with predicted taxonomy: Verrucomicrobia
  REGION 1..1037: note = MG1-306 effector
MTANETIWAFDLGKGSIGEAVRQGNKFLHKASLLIPADFAETKTAAGRRRMWRTRQAHKAREAWLDEVMRAAGIPVLQGRRVTWNEATKKWDVSLGDPRLEREFPAECDSTCYTSCLLRIKLLRGEKLEPWQIYKALHSAIQRRGYDPDIPWKNRAQRKAGTPDDDEAGTETRMKEFERRLEEMAPGKTEFQWPCYFDAKEMGLWHPAKPDELKLRQDCHAKTTRKQIVPRKLVEKEVRALVEAAAKFHPKLNGRADFILFGPAQRQYASFYADERKKHHLREGGANDWQGVLGQKIPRFDNRIIGKCVLIPRLNVCKIRTDDKGALLTQSRPAAEAVFLMKLKNMRLQCPGGQRGLTAKEIATIFTDPKRKKLGLTPTQWKNWCLLFGGKPLPGQYQEVKEPSFSGRSRFCRPALEILQRLILTGDTPQVAHDKERARLNGNTSPLKGLVPDDLMFLLKMGTTWEGIYIPNQKLDALAQSTDDPSETIRTLIGSQNDPIVRHRLTLFAERLNELAEKFGIPDAVVLEFVREDFMGKKAKIEYFKFQRDRAAQRAKAREEAAKAGAGEGAAGLKMELLEAQGGACLYTGEALAPTSLDDYVIDHIVPRAKGGPDSALNYVLTTRRANDDKADRTPHEWLSATNGWDAYVERVKKRTTALRNKKASLLVSPEAETLVQRYTALAETAWISKLAQTIIGLRFGWPNGIANGERKVIVISGGLTGRIRRKYKLNSLLNPDAKSEEEAEIKNRGDDRHHALDAMVISFLPTWARNSRFTGFFRFPDEVTRELFKREIAEVIPQNVCFERPALAETIYGARHDHGEKVIVQRAELISLAYKPTAPGKSVFDLKYAGKQTQSIRDNSIREGLAEFLSSGPTEIQWREFCGKYCLKNKDGTDGSRVRFVNMTVGDPTEYKDLSKDGTGAYRKALKGHKGQIVYLDEKGKPRVRPIYAFESAAAAKTELLSRNPKFRICGLFQSGCLVELTKPIEHPTNPLLPGTYKLNTILADGRAKVTDKTGKMTLPMSLEKFLAAGMKRIES

SEQ ID NO: 301 - protein, 760 aa, unidentified
  REGION 1..760: note = Description of Unknown:uncultivated organism with predicted taxonomy: Verrucomicrobiabacterium IMCC26134
  REGION 1..760: note = MG1-307 effector
HGHLRSEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPLLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMR

SEQ ID NO: 302 - protein, 1129 aa, unidentified
  REGION 1..1129: note = Description of Unknown:uncultivated organism
  REGION 1..1129: note = MG1-308 effector
MKMTQKQANNVFQRETVITKWQGAPFYTKDVVLGIDIGIEGIGIAVRRGPELLYCKTLMMKLPEQAPLEARRVLRSSRRARKSRRVRMNRLKQLFQKHGLPWVDDEIMARSDPFLLRDRAVNKNGLASKEALSICIRHLVAHRGYDFYAFLSDGEAPWGECSDFKAAKKWLSSTFVSEDIQEELLQDAENFFAEKDLEVWKALVQERLDWSRQNSMEKNLREYASNKANWRRGRGISYPRPQIEAHLRQIIERHKHLIKSHKKFTGVLFKKCDDDNKDICIFHYNRKTKEECEKVYERKIRTCPFAKYWDGAAQKCASRGDHAVRKWNLLDFLSNRRFRFAEGSIQIMRTMPEDCVKLLIDSLEESFDQKLTWSDHKQKLVESLKQHGLKIANPPKELSGKAKKSDAWKQLQDLLAPGKPLTSRAKLSSESAQKLFDTTTRNGTSFDPAQISARKKEMDYYEILSHTSMDYGVYPQVQKLLGTLRKPKAGEAPSFGTKGFLQRLFETELKDQLKRKTVPDRCIIECIKDPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTAQLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSKSKCKPLGDSTFWSVDEKGETWQRTTLIPLDKDALKDFTPEKIREKLAAEGIKESDIPGDRKLEAWLQNPKYSLHLKHGQPVRFVHKKGNKGDFRNPVGWSGIRHPNGKIDQLRKLDLVNDRLELWVGYDPKKGWQYYKRVIPSKDSMRGLKRLGIPWHGQEGLSEYTKKLINEENCKDLKEFYCGTLPQYSHKVGEFKLGDTFLIDVSKKKQKKQNAEGTEIFKDTPIPNSKEWFRVSAIILFREKGKKGIKRKVEFKPIITKGDSFTKEIACDLAQLLGKPKSPEKCAQQNGWKAPSNKKG

SEQ ID NO: 303 - protein, 892 aa, unidentified
  REGION 1..892: note = Description of Unknown:uncultivated organism
  REGION 1..892: note = MG1-309 effector
DELKLDSIRAWGKRGVLPEKYGNYLKLLIEDAGDFRGDKQAEALRIIDEAVARYRSDPIRTMLEEHLHERQHVNLRTPARGHNFPRELVKAHLREICERHRHFFPAEGFEEAMRELIGPVKNGAEEYDSKAESIMDWHRRTPGEARRLWERREGHCLLAPHLISTGLLPAGVYRRSPAGAGGIRRWKLVQFLAERRVELATGERTHVTADVVRQALDFVTADNAAVCERRRRPHAPKMPQAIEKAVGALASKKDSRLNADFFDQLGDLLKPSLSKLRGKAPLAEATAEALFQLATNGGANFEPEAIRARLNDSGYYDWRKHPGATRALYHQVDYLLGDARQYDPDTGEPKDHRDGAPRYHGLLRRLFAGQLRLDTGEIVDLRDRLDGRKVPDYVIIESVRDMPRNQDQSREIQKEQKERREERRHIAAIYGLDFDVLTEPQKRRLFLFHEQAGRDGEAVCPYTGESLGRDPLAADLEIEHIYPQRRGGLSIMENLAITRRATNAEKGNRTPVEWLGYEKAAEQASRMRWSKRKLEVFLWREERCPDWENLTRTAQLARELRRRVVEWLGIERRHAGIADPTQRALAREAEERRRVAAPAGALTAACREAWKDRLPEAYFTPIEIRGQTVLTKNRGNLRHHMWDAGVLAHIPPGDGLNHVRYGGIFETADIGGAPRPVPLPELAPDLAEIEKADPLACRVFHLRPRHPRSSRTTQQPVSLPDAEGRSWQRVAIRKTIHEKDGVVKTVEPENLLDAIRRAGLGPDRIADAEIERWKNDPRPIEQHPLRLRDGTPVHGLKIPIAQKKNEFGQYPHLTDAATAPDAPAYRSRDGRRQSRLIGIKGSTDTYDRLEIWRGPDLDRRGERRLDAKGQPKWKYFSFPVPGPRNLAAYRRM

SEQ ID NO: 304 - protein, 1205 aa, unidentified
  REGION 1..1205: note = Description of Unknown:uncultivated organism
  REGION 1..1205: note = MG1-310 effector
MNEYILREPDRKPLAEEWLNHEFYRSAVVLGIDIGLEGIGVYLRRGPQEIFARSIMLELPEAEALAERRQKRAWRHCRKNRKRRLHRLKLLFAKHGLPWLDADRISRAHPFRERYRAINNGVASKEALSICIRHCVVHRGYDYGGTEEGTFPWGESPLLSKAAEWLATAYVTPELKEQIEQLAPGLVPGKNEEEQRNKFAELLRERLEWSQQHDIARVLAEHVKGGHDNLRTRARGYNFPRQKVWEHLETIVRKHAHLIDDVEGFLAVLGLNPNRAANAKEAAKARKRAIFFYNRKTRFDMERHWEKKVNRCPFAGKLGGNPDERCAENGDLNVRRWKALEFATTRRVEIEATEGKGATKKKRRCLHSLSASATRKLIEFIEKHHGAASPATAPKWEEGKAIILDDITAVHGEKAKPVAEKQSEWNKSYFTQLKDLLTPTIANRKKRASLSAFAAGQLFNIATADGSDFTPENVVARLREARFYDWRRNASVDFNPFPQVELLLGRRIKHGKRRGELSPTCQGLLRRIFAEHREALGGATAPDYCVIEVIGDPPRNAQQRAERQKEIEANREKHEKLFEQYGIEDSGVASKRRRIMLYEQQRGKCPYTGKDLPSNPLDPSLEIEHIFPAEMGGLSVDDNLVLTWRSVNAEKGKRTPLQWAGERFDAMLANTRDMRWSARKREIFAWGTIREDKPDKPSHYNADGTLRVPDFGNTTRTAQLARQLRAEIMRWMQVDDKPDEAARRIGTPSGWLAAQARKSWLPAEEYEKVRNNVTHHLIDAAILAHIPPREGMNSVPCKGIFYVESVPVRDPVTGDTTYRLETKALPELSPLPRLKHWLPDNGEYDVCPVWKPRRQSKTQSLGDSTFWKQVRPTEATVAQRTALDADSLTKLRIVDGESLHAHLCRMGIQATKIPNRDALQKWLDEATAATKADKDKPIAPLKLTDGTPVKNLWKFDSKGSFSSPVGWSGKRNPDGKLRELRTISLKYDRLELWLGYDHQKAERARRAKQPDWEQAGWVYQKRLIPDARALRHVKQMGFSFARDKRHKAPAFMQNKPDKPETHQTLRDLVLGGRLLPFSHKVGEIRKGDVFKLHLLPDGSIRKRTPVGQPEPAAALSTFYVVTALKHGRGNPVVELTSQLFKDKEGTPMERFAGDVLSKILSTADDLAYVLGLPPAAEEAQKHGWRIPTSPPPPAAAAKETDGNLL

SEQ ID NO: 305 - protein, 1231 aa, unidentified
  REGION 1..1231: note = Description of Unknown:uncultivated organism
  REGION 1..1231: note = MG1-311 effector
MNELISPNTAWKTQSEYWLQHEFYRTAVVLGIDIGLEGIGLYLRKGPQEIFARSLILDLPQAEALAERRAKRAWRHCRKNRKRRLHRLQLLFAKYRLSWLPAERMSRSNPFKERLRAVTTGVASREALSICLRSCVAHRGFDYGGTEEGQYPWGGSSKLSDATQWLHTAVVTNELKDLIEDKLDELEADKSPEERRAAFRDLLRERLDWSLHHDIEMILREHAKGGHDNLRPRARGVNFPRKEVWKHIEKIVRHPRHREFLPDPEAFLKELGIDPNKAGGASPKERLANAARARRKAIFFYNRKAYPEMERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPPLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKKHGQLAESCQGWLRRIFADQSEALDGCTAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELKATLQRMRVDWNKQKQQTESKIPSRDALQDWLDAATPTTKADKNRPIPTLKLTDGTPIKSMWKIDSKGSLTSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLSVRDLVLGGRLLPFSCRVGAIKKGDEFLLHLLPDGSVRKRTPGGEAEPAAAFSTFYAVTALSHEGGNPRVELKSRLFKEKEGTPLERFPGDLTTRKVAVSSDLAFLLGLPPAWIAAQQRGLRPPSPQIEHAKTTTERNSRDPNPRLL

SEQ ID NO: 306 - protein, 923 aa, unidentified
  REGION 1..923: note = Description of Unknown:uncultivated organism
  REGION 1..923: note = MG1-312 effector
MERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPTLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKKHGQLAESCQGWLRRIFADQSEALDGCTAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELHATLQRMRVDWNKQKQQTESKIPSRDALQDWLDAATPTTKADKNRPIPTLKLTDGTPIKSLWKFDSKGSLSSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLSVRDLVLGGRLLPFSCRVGAIKKGDEFLLHLLPDGSVRKRTPGGEAEPAAAFSTFYAVTALSHEGGNPRVELKSRLFKEKEGTPLERFPGDLTTRKVAVSSDLAFLLGLPPAWIAAQQRGLRPPSPQIEHAKTTTERNSRDPNPRLL

SEQ ID NO: 307 - protein, 1129 aa, unidentified
  REGION 1..1129: note = Description of Unknown:uncultivated organism
  REGION 1..1129: note = MG1-314 effector
MKMTQKQANNVFQRETVITKWQGAPFYTKDVVLGIDIGIEGIGIAVRRGPELLYCKTLMMKLPEQAPLEARRVLRSSRRARKSRRVRMNRLKQLFQKHGLPWVDDEIMARSDPFLLRDRAVNKNGLASKEALSICIRHLVAHRGYDFYAFLSDGEAPWGECSDFKAAKKWLSSTFVSEDIQEELLQDAENFFAEKDLEVWKALVQERLDWSLQNSMEKNLREYASNKANWRRGRGISYPRPQIEAHLRQIIERHKHLIKSHKKFTDVLFKKCDDDNKDICIFHYNRKTKEECEKVYERKIRTCPFAKYWDGAAQKCASRGDHAVRKWNLLDFLSNRRFRFAEGSIQIMRTMPEDCVKLLIDSLEESFDQKLTWSDHKQKLVESLKQHGLKIANPPKELSGKAKKSDAWKQLQDLLAPGKPLTSRAKLSSESAQKLFDTTTRNGTSFDPAQISARKKEMDYYEILSHTSMDYGVYPQVQKLLGTLRKPKAGEAPSFGTKGFLQRLFETELKDQLKRKTVPDRCIIECIKDPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTAQLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSKSKCKPLGDSTFWSVDEKGETWQRTTLIPLDKDALKDFTPEKIREKLAAEGIKESDIPGDRKLEAWLQNPKYSLHLKHGQPVRFVHKKGNKGDFRNPVGWSGIRHPNGKIDQLRKLDLVNDRLELWVGYDPKKGWQYYKRVIPSKDSMRGLKRLGIPWHGQEGLSEYTKKLINEENCKDLKEFYCGTLPQYSHKVGEFKLGDTFLIDVSKKKQKKQNAEGTEIFKDTPIPNSKEWFRVSAIILFREKGKKGIKRKVEFKPIITKGDSFTKEIACDLAQLLGKPKSPEKCAQQNGWKAPSNKKG

SEQ ID NO: 308 - protein, 953 aa, unidentified
  REGION 1..953: note = Description of Unknown:uncultivated organism with predicted taxonomy: Verrucomicrobiabacterium
  REGION 1..953: note = MG1-315 effector
AGASKKERLPHAAPPRRKAIFFYNRKSRPEMERHWATKVNECPYAHRLDPGLAGTKITCGENGELPIRKWSALEFSATRRVEMETIFGKGKEKRIRRSLHSLSGRVVGKILETIERHDRALNSGDKAAAPSWDEVKAIIEDDLRTLADAKVKLATSKKGDWNETFLAQLRNLTLPSLANRKQRASLSALAAERLFALATHDASDIDPAQFAPRLKAIGFYDWRRAATVDFNPYRQVEVLLGRRIKRGKKRGQLAESCQGLLRRIFAEHSEALDSSAAPDYCVIEVIGDAPRTTKQAQEIKFAQDERGQKRRELFAARNLEDSGVASKRRRISLWDQQKGVCPYTGNELPKDPLDPSLELEHIFPAEMGGLSTDENLVLTSRTVNSDKGKHTPLQFANKLRVPFDQLVAHTQDMRWSAKKREIFAWGTLREDKDDQKSHYLPDGVSLRVPDFGNTTRTAQLARQLRAEVMRWMHVEDQPDEAARRIGTPSGWLVAQARKSWLAASDYQKVRNNLTHHLIDAAVLAHIPPREGMNSIICKGIFYDVRERVRDEATGITSHRFLTKALPELSPLPRLKQWLPDNGEYAVCPVLKPRHQSKTQSLGDATFWRQVRQGEPALAQRTALNPENITDADELHATLQRMRVDWNKQKQQTENKIPSRDALQNWLDTATPATKADKHKPIPPLKLTDGTPIKSLWKFDSKGSLSSPVGWSGKRNLDGKLRELRSISLKYDRLELWLGYDHKQAERAHKSNTPDWEQSGWVYQKRLIPDARALRHLKQMGFSFGRDKRRKAPAFMQDKPDKPETHLSLRDLVLGGRLLPFSCNVGAIKKGDEFLLHLLPDGSVRKRTPAGQAEPAAAFATFYAVTALSHEGGNLRVELKSRLFKEKEGTPLERFPGDLTTRKVTVSADLAFLLGLPPAAVAAQHHGLRPPPPRIEHPKATTEMIPRDANPRLL

SEQ ID NO: 309 - protein, 993 aa, unidentified
  REGION 1..993: note = Description of Unknown:uncultivated organism with predicted taxonomy: Thiorhodospirasibirica
  REGION 1..993: note = MG1-316 effector
GPGLDALEPFRKDRKTGAWIPQHTLRRDSLFFKEWQSEVALRNFRVKRRLITVGRSKKEKFELIPPPPVALERLRNLWNEHGHLWAEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMRVYRLPKPGRSGAYACWLLLPWYGMLDARGKRFKTVEKDLMTRACKGAKFVRAFRRDDIVCFANNLLANKGIKQNESWRIVRTDAKGDCLANVGLLPANLARETSHPITGEKVKLEPVVVALNDFMNALEPRLPTDELSHSPPVKPKSPGAAET

SEQ ID NO: 310 - protein, 1119 aa, unidentified
  REGION 1..1119: note = Description of Unknown:uncultivated organism
  REGION 1..1119: note = MG1-317 effector
AERMSRSLPFRERHRAVNKGVASKEALSICIRHCVEHRGYDYGGTEEGAFPWGDSPLLSKAAAWLSTAYVTPDLADKLQDIEPQLQAGRKEEEQREHFLYLLRDRLAWSGENDIARVLADHSQGGHDNLRTRARGHNFPRTKVWEHLEGIIRRHAHLRADVEGLLAVLGLDPNREPDAKRAVKAKRRAIFFYNRKTRLEMERHWAKKVNICPFAAKLGLDHPEERCAENGDVNIRRWKLLEFAATRRLEIDVAEGKGATKKRRSLLHRLSADAIRKLVETVQKHHAAVVASNRDAEPKWDESKDTILEDITTAWGERAKPIPETKSDWNKSYFSQLKDLLVPTLSNRKQRAALSAASAVRLFDLASADGMSFTPEEVIERLRKAGFYDWRRDASVDFNPYPQVEVLLGRRIKRGAKRGHLSETCQGLLRRIFAEHEEQLEGKTAPDYCVIEVIGDPPRNALQRAERDQEMKERREKRNKLFEQHHLDDSGVASRRRRVTLWEQQKGKCPFTGKELPANPLDPSLELEHIFPEDMGGLSVEENLALTWRTVNADKGKRTPLQFAAKLGVPFDQLMAHTQEMRWSAKKREIFAWGAIKEDRGDQASHYNPDGALRIPDFGNITRMAQLARQLRAEVMRWMKVEGDPDEAARRIGTPSGWLAAQARKSWLAQGDYEKVRNNLTHHLIDAAVLAHIPPREGMNSVLYKGIFYVVREPVRNEITGTTSQRLLTKALPQLSPLPRLNHWLPDNGEYAVCPVLKPRRQSKTQSLGDATFWRQVSPVEGTLAQRTVLNPEKITDADELHATLQRMRVDWNKKQQQTENKIPNRDALQAWLDAATPATRADKDKPVPPLKLTDGTPIKNLWKFDSKGSLSSPVGWSGKRNADGRLRELRSISLKYDRLELWLGYDHQKAERARKAKTPDWEQAGWVYQKRLIPDSRALRHLKQMGFSFGRDKRRKAPAFMQAKPDQPETHLTVRDLVLGGRLLPFSCKVGAIKKGDEFLLHLLPDGSIRKRTPAGQPEPSSAYSTFYAVTALSHEGGNPRVELKSRLFKEKQGTPLERFPGDLITRKVAVPSDLAFLLGLPPAGMAAQQRGLRLPPPQIEQITTTTEMNSRDPNPGLL

SEQ ID NO: 311 - protein, 1000 aa, unidentified
  REGION 1..1000: note = Description of Unknown:uncultivated organism
  REGION 1..1000: note = MG1-318 effector
HRLQLLFAKYRLSWLPAERMSRSNPFKERLRAVTTGVASREALSICLRSCVAHRGFDYGGTEEGQYPWGGSSKLSDATQWLHTAVVTNELKDLIEDKLDELEADKSPEERRAAFRDLLRERLDWSLHHDIEMILREHAKGGHDNLRPRARGVNFPRKEVWKHIEKIVRHPRHREFLPDPEAFLKELGIDPNKAGGASPKERLANAARARRKAIFFYNRKAYPEMERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPTLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKQRGQLAESCQGLLRRIFAEHHEALDGSAAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELHATLQRMRVDWNKQKQQTESKIPSRDALQDWLDAATPTTKADKNRPIPTLKLTDGTPIKSLWKFDSKGSLSSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLS

SEQ ID NO: 312 - protein, 1078 aa, unidentified
  REGION 1..1078: note = Description of Unknown:uncultivated organism with predicted taxonomy: Verrucomicrobiabacterium IMCC26134
  REGION 1..1078: note = AKC83434.1 effector
MVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 313 - protein, 1078 aa, unidentified; identical to SEQ ID NO: 312
  REGION 1..1078: note = Description of Unknown:uncultivated organism with predicted taxonomy: Verrucomicrobiabacterium IMCC26134
  REGION 1..1078: note = AKC83434.1 effector

SEQ ID NO: 314 - protein, 862 aa, unidentified
  REGION 1..862: note = Description of Unknown:uncultivated organism with predicted taxonomy: Verrucomicrobiabacterium 61-8
  REGION 1..862: note = OJV06180.1 effector
MEAYVDELNAMSPLQLEFQLPSYFDAWKMGLWNPKNPTELKDRIDCHAQSTRNKIVPRWLVEKEIRLLAENAGKQIPELAGKSDYLLWGPTRRPYASYDCSVRKEFGLREGSVTDWQGVVGQKTPRFDNRIIEKCTLIPRLNVCKIKSDGKNPLPESRIVFETTFLMKLKNMRVQQGPTEQRGLSAAEINAIFKDEKFRSFKITEAQWNKLCISMGVRPQPGYETVDPPRSGGRSRFCRTSLEILKRLILSGKNPPEFLEEELRRLNGNTDPKRGLIADDLKFIEKMGSTWEEIHIPNQRLEAILQLAGGADAAVRQIIGSQTDPIVRHRLDIFYQRLQSLREAYGTPKSVVIEFVREDFMGKKAVIEYRAFLKKREAERKRAREDAAKTGSTERSAALKLELLREQGGICLYTGSALKETALEQYEIDHIVPRSKGGPDAVINYVLTLRSANDEKGDRTPFEWLSRTNQWDAYVQRVDSRGTVLRNKKTKLLLNENASELAERYTALAETAWIAKLSQAILDAFFGWKNGVDDEGRKRVISVNGGLTARIRRKYQLNSILNPSLNEEEAEKKNRSDKRHHALDAMVINFIPSWTRDTAKEHFFRFPSGIHRETFVQQIANVTPRNLCLEKPTLTETIYGARRGDQGLVIVQRAKIVDLAYRSITPSKSVYDLTYAAKQFKAIRDAHIRRLLEDFLKRNPTEQDWQEFCASFALPRRDGTLGSRVAQVTMNIGSASEYKDLSKDESGSWRRGKRHRGQIVYLTDGKPKVKPIYAFESEQEALKELLLSGAKIVGIFRSTCAVRLTEAVTHPKTPLVAGLYVLNTIREDAFAVLTDRSGARSQPISLNKLLAAGFQRVESLEI

SEQ ID NO: 315 - protein, 862 aa, unidentified; identical to SEQ ID NO: 314
  REGION 1..862: note = Description of Unknown:uncultivated organism with predicted taxonomy: Verrucomicrobiabacterium 61-8
  REGION 1..862: note = OJV06180.1 effector

SEQ ID NO: 316 - protein, 1324 aa, unidentified
  REGION 1..1324: note = Description of Unknown:uncultivated organism with predicted taxonomy: Pedosphaera sp.Tous-C6FEB
  REGION 1..1324: note = PAW75411.1 effector
MLRPCVRKDRLTVLCRPPGRLPSRREFLRLDQPRRAEGQLGIVTSDPCPCAGGKHLICRKAAGNNGSMSAKDYVLRGAVPMDSTLMPNHIWAFDLGKGSEGEAVRHGTDFPHVESLLIPAELARRGPAATSGTPANKYRALKTREAHRARERWLETVWTAAGFTPLHGRQVAKVCSLPVKLDENGEPKFDKGHWAQVAKGDYRLEMEFAPKLGTKTKDGAPSDLAGADICYTSCLLRIKLLTWKESGPKVADWQIYKALRSALQTRGYGRVPWAAKESQREQQTKEEEAKETETATRWAEFKQSVAPEFRFPCYYDAAKMGLWNPAAPNEPTPQNSHLANSTRNVRFDRADVECEIKQLAENADRILEGRLSLAKEKLVQEFMEGRRKRVREINERRALKNLTLPPDKRKQPRKDPAFQRISASVADFFCYGPSGVSCASYDRSLQADLALRAGSAYDWQGALGQKVPRFDNRILNDCVLIPRFHVCKVDVRVAEKDDDKQGVKAGQVFADSLLATEVTFLLKLKNVLVADLEKGQRKLKAHEVRAIFEYAHRQLQSLKLLSQDGGLVKNWPGKVADCFALTKSEWGNKKKGIGLLGLRPLAGHEEVKAPKTGGRSAYSRAALRILKELILSGEAPSVFHARLLKREPELLGRLGSSLAKPLALHADSTAQDAEQSKREDTEHRKCGLLVSELKFLLQMRKEDGQPDSWENLFAPSQTLDALKGRHTTDGKLDSEAAIRELLGTINDPIVRHRLGVFAGRLKKLQFGDAKENIQAFGVPDAIVLEFVREDFMGEKALAELQDFQRRREADRKEAKEMAAAAGATSSLSALKYQLWKAQGGECLYGKEVFNESGVSKAQCLYRGTALPFTKLDDYVIDHIVPRAKGGPDAMVNYVLTTHETNEAKGDRTPFEWLRSAPDWDAYNKRVAARAHTLRNKKVQLLTREDAPELVQRYTALAETAWVSKLAQAIVNLTFGWTNANDEEGRKRVIVVSGGLTARVRRKYSLDKLLYTNTTDPEVLTKQVKNRSDKRHHALDAMVLTYIPQWARDPGKEGFFRFPAEFRDATGREDYSAIQRLFKDKLAKTTPRFLAYERSGLADTAYGRRTDGEKCVVVQRTPLRGLAYKQVKMKSVFSLEYAATQVAAIRDGRIQAEMKRVIAAQPNEAQWRAICDALENGTHSGFEGVRVVKVTVNRNEDPAEFKDLSKDGTGALRMRKKEHQGQFVFLDSKGRPRVEVVRVFDSLRDVKARLAKEHAGLKEVGFFQSMCQVELDQPVKHGNCTLLPGTYLLNTIKQDGRAQLTSAGGDKSPEIGLVKLLPAGFRRKA

SEQ ID NO: 317 - protein, 1324 aa, unidentified; identical to SEQ ID NO: 316
  REGION 1..1324: note = Description of Unknown:uncultivated organism with predicted taxonomy: Pedosphaera sp.Tous-C6FEB
  REGION 1..1324: note = PAW75411.1 effector

SEQ ID NO: 318 - protein, 1086 aa, unidentified
  REGION 1..1086: note = Description of Unknown:uncultivated organism with predicted taxonomy: Verrucomicrobiabacterium IMCC26134
  REGION 1..1086: note = WP_082083265.1 effector
MSQVTGLPLVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 319 - protein, 1086 aa, unidentified; identical to SEQ ID NO: 318
  REGION 1..1086: note = Description of Unknown:uncultivated organism with predicted taxonomy: Verrucomicrobiabacterium IMCC26134
  REGION 1..1086: note = WP_082083265.1 effector

SEQ ID NO: 320 - protein, 1333 aa, unidentified
  REGION 1..1333: note = Description of Unknown:uncultivated organism
  REGION 1..1333: note = MG2-1 effector
MPTTNPYVITHVTKNWMKDEFYDSALVLGLDIGIEGIGVWLRKGREPLFARTFMVSLPEAAPLKNRRAKRAQRHARQSLRRREAMLREWVVRYGLLPQEKTDGRWWKNPAVFERAFEHRHRAITTGVASPECLVVCIRHLLRHRGFDYHLTDEGAFPWGDELDDKEIIQWAKNSCCAPEYRTHLCNLIEADAAWAKNSDGSFTEKYLKVRQALDDAVREYENRPVERMLEQHMSEKNHPHLRPRARGRNFARELVKQHLYAICEKHRHFFAPGTFDQAMRELLGDQTGPSQWKLTWMDQDGKARQTILDYHRRTREEAEELWKRKVKKCPFAPLLFEKRHPTTPQHDCAVRSDPRIRRFNLLMFLAERRIELETHDAEGRLQNPRVNLDANVVRDLLGDLEQDIRAVEALRNKQSASRPDKPGKKTFEQRWRICNDCGKETGQDETGKSSCCKAKTKPKMPLAGVAKGSFNADFFDQLGDLLRPELRSLKGRASLSGEAAEVLFKLVTRNGTDFEPARIRQALEDCGYYDWRTNLPAGLGIYPQVTFLLGNRGHYDKDGNPRQIDKTTGNPVHHGILRRLFAGQLRLDDGTLVGLKDKLDDKVVPDYVVIETIGEIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMAQLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRKSKKSRYKETIFSLPDQQNRVFAREPLSKVVTSLLKSKKKNPDAELRKLLDRPGLLNPLEITNKKTGQTKQIKLLNKADVERWLSCKDVSLDQEGFRKFIEDVGVPTEQIPDDAVKAAFMKRNGETLLRKTFKPNSLVSFIRQKCRIKDSEIEARVEIAIAERNERTVLRAANGRDGQPGQVIRSILIEQDKLPPCGFGLHFNPTAKPKRGSEVAGFKPVDNSNSVVYLRREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNGTIEFQMAEFAEPKLVKGQIPDPATERLLETYELTCSNEADLLWLLEVTTGKRIKLPPPVVENAPTTGKREGELL

SEQ ID NO: 321 - protein, 1080 aa, unidentified
  REGION 1..1080: note = Description of Unknown:uncultivated organism
  REGION 1..1080: note = MG2-7 effector
MKQGQIAFSFDIGHSSIGWAAFQVSDAPGTFHSLLGTGVVLFPKDACLASARRGFRRSRRNIAARRSRIDRLKNYLAGLGVLSRDQLDANSNSYPWLLAARILASDGKKTLTWEELWSVLRWYAHNRGYDGNALWAGDDADAGDKEDTDKVKNSIALMEKHKTATMAETVCKALGLDPMGEVKASRIYFKGNNAAFPRGVVTEEVRRILAAHAGKLPKVDDALSDILLRNAATSGLELPARFKGGLLFGQYVPRFDNRIIPACRITGKNTPLKRCPEYLLYRWGRLLNNLTVFGADGQIRTLLPAERQALHSRMEADGFFTKRTLNAALKDVTGCTPANTESFFLTEEMEEALVLDPVKKLLATNQIMKDLWPQLSAESREKAQSSLSAGKKIRLGDILAEMETAGQDTTAASDALASHQKKAKKKNADLATRRLSADYPKGRAAYCREILAKTFDESISGKDSTKEGGCLYETEEIRNRLLREPLVQQTNNHLVRHRLLVFERLLAHMVEEFAGGDEKRIAATVVEVVRELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDLTQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIPAKMHGIIVDQTTWGTVAAGAITTLRQKTTEKNARCDENGKRFIKTTEKKRSLLLGGPDAPDGKLAKIKGAILVTENWGCALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 322 - protein, 1471 aa, unidentified
  REGION 1..1471: note = Description of Unknown:uncultivated organism
  REGION 1..1471: note = MG2-3 effector
MGNRADLELAFDVGHSSIGWAVLKTQPELEMKGCGTVIFRPDDCLASKRRDYRRQRRHIRSTRLRIERMTNLLLGIGAITQSDVESGKKQHKGEPPPWLLAARVLAARTETEKAKALLTWPELWKVLRWYAHNRGYDANVRWSGESKVEAFSPSPQINTEDVEEQAVEAEESELADVEVAEDSDSDSDKLRAGKHLMSSKYGFHTATFAETVAKILLGPKRDVKPGQAGKTGKLAETTESFSESDFRKLLFDTPTESWSHPRHLSIYFKGIRAAFPRRIVKVIGGQRTLVGGTEWEVRAILRAHFDAPKGKALCDETFEAAICGRLPETREDWRAYAETHPTLYLSSDDQAKLRSLRAPPKASQEKSERIRQQRRNILTGKLFLPSRYEGGLLFGQLGTRFFNRIISRCPFSFARIVAAILSGDENTLRLYGTTLAAVNRSRHSRNGVMETDLDLARRWAAKLSKVPAAKSREFLLYRWAMTLANVIVARPGRERLTGYERRCIHRRLRRTGYFTKDSFKEAVRQTTGCEPANLDQMFDTTTEAENSLFIDPVRKYLATNEVAGVVLPVLSQFLQVRLARLLQKGKGVRVREIAEWLDETAKRELSQRIEQYVQENNAKAKAAKKKPHDTHSPDEDRRKKQNKLTAAAVLRVRLEAPLPKGRASYHRVVLRKAVAEVLKGFDPRKPKRDRSNTDGENKPSHGCLFRTPETNRQLLGNPNNEAEYERWKQRWLSHQKNYQRYIARERLSPGSGEAFVRSEYHAAQSYRWLASQSNNHIVRHRLTILDRLLRDIIADQNYCAGDPKRIRRISIEVANDILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDLTITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTPADMSGLAAEETVWRIFDPSDNHPSARRLKQWFEKKIKDGEIQKLPDPTNEADKTVLIVCRKRRDAKSNDKGKTLHDTGNVWRWVYDEVNKVRVVGLNPGKLHRIKAVKLIRENFGIALDPEPTIVPFHKVWQRLMELKAKNGGKMPRVLRNGQLIRVLSGSRAGLWRVTSVKQTEAYGLVLDLAYPDSVHLSRPNAPVEQLLKEGLEILKHSLTGYDASVVAYAPVKRRPRKPKAAQSEQ

SEQ ID NO: 323 - protein, 1196 aa, unidentified
  REGION 1..1196: note = Description of Unknown:uncultivated organism with predicted taxonomy: Verrucomicrobia
  REGION 1..1196: note = MG2-5 effector
MNNKMKIPTMKIAASKADLQLAFDVGHSSLGWAVLQTTPEKASSIELLGCGVVTFRADDCLASARRGYRRQRRHIRSTRQRIKRMKTLLIHLGVLTKAQLDQPGCAWPWLLAARVLHGGKLLSWPELWDVLRWYAHNRGYDGNRRWTKQEVTPDESTDFDDSELERILSDATATEDEKSDAEKVKEAKILMRSHGVKTMAETFCAICGLDPLGQKKSCNLPGDKRPKAMNAAFPRAVVEGEVRRIMRAHFGGKLPKVDEALERMLLGLNSQDKVAWRAIPCPGLKLPKRYQGALLFGQLVPRFDNRIIATCPITHYQEYQRALGAIRDNDPAYLKKHSVNLDNHDPSWWAKHIADKLAKVPSRDCVEFMNFRWGMQLANIRVARFGEKELSPLKVEERKQLDDMMRAAGAMGPGEFKKSVRHVTSAIRDNLDTMLMHPDAKDALVLDAVQKLIRSDDLESIWKLLPERLQKRTRGRWRQGWRISFADLRRQLAELGGDTEAFDAELTRQVDAANVNLKKKGKQTTREELLKKPFFVKKLGQRAAFARHLLKQAYEEVMAGSHPKEKDGCLFISEEMREAQLQREIAQQTNNHLVRHRLLILTGNEKAKPHPKEGLLQHIIKEYAGGDGTRIGKITIEVNRDLREMSGKSNYDKQADLNNRVKNHHSVVEYLHEHLPAKYHNRINGSLIRKARVAADLDWKCPYTNEAIQPIHLITKVVDLDHVVPHALRPSDGLDSLVVTFCAVNKMKGKRTAWQFIKDEETRSVSYRNEQGKEEKVDGMPNLKIRFFSDYKKFVDDLKIKAKGEHKADAERRERRQQLLRLANYEEKAFLPRDLTQTSQLVRLAAQALRRNLPHLGPENVVSLPGSVTGMVRKSWNVTGCLELACPQVMEEVVDQDGKAVRRAKDKGEIRGITHLHHALDACVIGFSSHFIPNNGGLWELMVKRRWTPAEEKELEARRVFSKGMDGRFQMTDLHKRHKEAIRQRLAEKRVVQHIPARMDGLRVEQNMWRVVSVKDGEATLRQRIRHVDGSRPKKAGTEKKTKLLGLEPGKLQTNKGVLIIPDNFGVALVQPEPVIVPFHKVWVRLRDLKKVNSGTKPEIIRNGQIIRIAEGKYKGVWRVFSAKNNSTGMALDIGLPDVVRLKNKTEGHKINVLLSSLVKNGIEAIKAPLTGVPVSAGKGESHSSPLEPRQSSNAS

SEQ ID NO: 324 - protein, 1119 aa, unidentified
  REGION 1..1119: note = Description of Unknown:uncultivated organism with predicted taxonomy: Verrucomicrobiabacterium
  REGION 1..1119: note = MG2-6 effector
MQVENFLNKVENRELEVAFDVGHSSIGWAVLSRKTSQESQNVAEYFYPEIIGCGVVIFEPDTCLAKKRRDYRRQRRHIRSTRQRIKRMKSLLQHLGVLTEAELDKPGNSSPWKLAAKVLQNSGLLTWQELWDVLRWYAHNRGYDENRLWSETLPDDEKEESKRVENARKLMAQFQCGSMAETVCKMLGVDPLSTDKRSSHLRYKGTDIAFPRNVVVREVREILKKHIGKLPQVSEQLVETLTGDKENSWKTIPCPSINLPKRYYGSLLFGQLLPRFNNRNIARCPISGEKLPLKECVEFYRYRWAMLLCNIRVKVNGSKERPLNVNEREYINGIMEKKGFFTKHELRIAVNDAVMQTLKNENYNGTPVILTNISAMFLTEDMEKALTLYPVKKIINSEKVQVFWNIIPERLQKRISGLWRKGKQITPQEFRNQLEKISPEKLLDFDNAVEEFLKKNRKEKNYLESKIPDSPLKDLQGRAPFSKAILKKAYEEVLSGRDPREEGGCLFRSEEIRLRELNKKITEQTNNHLIRHRLLILERLFDDIVKEYANNDKNRIGQVTIEVNRDLREFSGMTAKEIASELTKITSDHRKAVQYLEENLKGKPYKITASLIRKTRIAMDLDWTCPYTGQKYDIYDLLEKRVDLDHIIPQSIRPSNSLESLVITFPEVNRFKAQRLAFQFVKEEQTKTVKGLPNLQIRTLENYKNWGENLKESRFDRNKSPQSKRKKLLLLPEYVQEEFLPRDLTQTSQLVRLAAQVIRKKYVDSKEPKIVSMPGSVTAVFRKSWKVMGCLSKAVPAILDENGEVRPKDEIRNITHLHHAIDACVLALASHLFPNNGRLWELLVKNKLNSSEVDELKKIPLVQVGVDNKINISDLPEFIKEQISNRLLERRVVQHISKDMSGLKCDETVWRVVDQNCDNSYGKKLLRWCKEMNVEIPAPDSDSVLIVSRKRKDKGTTKPTKILHESQSFWWQYDIVKKSKVIGLNPENGDGKLKKLKAVKIIGDNWGLALDPKPQIIRAFKIYQQVREIKNANDGKPPRIIRKGQLIYVPNGRYKGLWKVFSVKDKKTGIYLDIGEVDQVSLRSERKSAKENVDVRTLMKNGLRPLSTPYTGINACLIT

SEQ ID NO: 325 - protein, 1056 aa, unidentified
  REGION 1..1056: note = Description of Unknown:uncultivated organism with predicted taxonomy: Verrucomicrobia
  REGION 1..1056: note = MG2-8 effector
MASRRNAPDLQLAFDVGHSSIGWAVLQANPDVEIAGCGVVIFRADDCLASARRGYRRQRRHIRSTRQRIKRMKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 326 - protein, 985 aa, unidentified
  REGION 1..985: note = Description of Unknown:uncultivated organism with predicted taxonomy: Verrucomicrobia
  REGION 1..985: note = MG2-10 effector
MKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 327 - protein, 952 aa, unidentified
  REGION 1..952: note = Description of Unknown:uncultivated organism
  REGION 1..952: note = MG2-11 effector
WTAADIETLKEDTEKEENAINLMQKNGLTTMAETFCKELGIDPLGSKKSSIVRFKGFNAAFPRKTVEDEVRRILRAHFNKLEKANADLERALLGRDRNDKLAWQAIPCPNLKLPARYQGGLLFGQLIPRFDNRIIVRCPITGQKVPTRHCAEFLNFRWGMQLANIRVACGGERWLHPLNVEERKAIDARMREQGSMTEGELKKAVRTNTGCSRDNLDTMLMHPDAKGALLLDPVRKLTKSEKLKTLWPLLPEPVQRRAANMWRRGKAITLLALRDRIETAGSSPAAFDAEVERLLDAANTKKRRKDQPITREELLAEPLVVRPLDGRAAYARRILRQAFEEVMAGKHPTKEGGCLFRSEEIRAAQLQCRVDEQTNNHLVRHRLLILERLQSDIIKEYANRDPARIGRATIEVNRDLREISGKTAKEKAQELGQRLANFKSVTKKLEEAFEGRNVHISPGLIRKARVAEDLGWTCPYTGQRYDPLDLLNAKVDKDHVIPRTERASDSLDSLVITFPAVNKWKDKRTALKFIEDEQGQPVLDMPNLSIKTFAQYEADVKALRPSFDPRPAKRDGRTKGPIDDDLRRWNRKQLLLNVRKWEEKEFLPRDLTQTSQLVRLGAQILKKGFTGLERQPVITSMPGSVTGVMRKGWNLIGCLSAANPNVLDEIGQPKIKTEIRDITHLHHALDACVLVLASYFIPNKGAVWELIVKRRLDETEQLQLRTATRGIFNFSPGRRFGLADLPNSLKEQIRQRLAERRVVQHVPSEMTGLRTEENSWRVVGIENGEALLRQRIRQPDGSRPVKEMRERTEKLIGPEPRNRTGKLKRNKAALIISDNYGVALDPEPTIIPFHNVWKRLAELKQANGGRPPRVLRNGQLIVVPNGKFKGAWKVFSAKNNKSGMALDIGWPDVVRLRNKVEGHKINVLLASLLRSEMRLAKTPLTGMAACPSTSSA

SEQ ID NO: 328 - protein, 829 aa, unidentified
  REGION 1..829: note = Description of Unknown:uncultivated organism with predicted taxonomy: Verrucomicrobiabacterium
  REGION 1..829: note = MG2-12 effector
MNAKRKNEVAGGTKPDLQLAFDVGHSSLGWAVLQTGEANSFEVSLLGCGVVTFGADDCLASQRRAYRRQRRHSRSTRQRIVRMEKLLLYLKLIEPQQLATKHQQAGGHPAPWLLAARILASNGDPRYLLDWPELWDVIRWYAHNRGYDGNARWANACDRALSDAEQEEKKADTEKEKKADELMENYGKKTMAETVFADLFAPFHLNDPTKVSSLPFFQRRFKANQCAFSRETVEAEVARLLDAHTGNLKGCNKQFIRLLLTRKLMGEDRGMLSEAGIRLPKRFEGGLLFGQLVPRFDNRIIAACPVTGEKVPNKHCLEFLEFRWAMTLANIGVGFGTETYRNREGNESTLRPLTGDERRKVDARARRLGFLKAEPDRPGKDGLVRSGRNELREIVVAATNCDRHNLDTLLLHPDAREGLRLLRVKGDTTAFRVAWGSFGDPLDIQGHYHDDPLRHRFTTQLLRLKKLNLRSILSELERLGKVEVALCLRAAAELQAKGKKVKLDPIKLDGLLDAEFSCDKLKGRARYSRAKLAQAVQEVFNKSEPIHPLQKGGCLEQTNEIKQAALDKPMDQQTNNHLVRHRLLILKRLQEHLFNDYADGDKLRVSRITVEVARDVQTTSGMTNKEKAKELGSKIKHHHETAAWLAERLEDERDENGRRFVIGPSLIRKARIADDLGWECPYTGRKFEPADLIHRRYDKDHIVPRSKRLSDALEAMVITSCEVNREKKNRTALQFIKDMNLPENRAVRERLNIRTEAQFREFVDELKAKGSHADDVRRRKRRKELLLVQKYEEKEFTPADLTKTRFINKLAAQQLQAAFRDLPEQQRPP

SEQ ID NO: 329 - protein, 1083 aa, unidentified
  REGION 1..1083: note = Description of Unknown:uncultivated organism with predicted taxonomy: Verrucomicrobiabacterium
  REGION 1..1083: note = MG2-13 effector
MNTTASPDTTSKKSIGDLSLAFDVGHSSIGWAVLQNIDASAPSILGCGAVIFAADDCLASQRRTFRRQRRHVRSTRQRIARMKALLAHLGVLSREQLDQPGCAWPWQLAARALCGGPLLNWSELWDVLRWYAHNRGYDGNRRWSAADIEMLKEDTEKEENAINLMQKNAVTTMAETFCKELGVDPLGSKKSSTVRFKGFNAAFPRKTVEDEARRILRAHFGKLEKVNTDFKRALLGRDTNDKLAWQAISCPDLKLPKRYQGGLLFGQLVPRFDNRIIMRCPITGEKVPTRHCAEFLNFRWGMQLANIRVASGDGRELRPLNVEERKATDAQMREQGSMTEGELKKAVRSVTGCSRDNLDTMLMHPDAKDALLLDPVPKLTKSDKLKPLWPVLPERVQRRAANIWRRGKAITLLGLRERIQMAGGSLATFDGEVERLLDAANTKRRRKVQPITREEFLAEPLVVRRLEGRAAYARLILRRAFEEVMAGKHPKEEGGCLFRSEEVRAAQLQRRIDEQTNNHLVRHRLLILERLQRDIVKEYLGGKSAHIGRVTIEVNRDLREMSGKTAKEKAQDLGQRLANFKNVAEKLEEAFEGKDVHISPGLIRKARIAEDLGWTCPYTHHSYDAFQLLNRTVDKDHIIPRTERASDSLDSLVITFSAINKWKGKRTAMKFVEDEQGNPVPDMPNLSIVTLTHYKAFVEGLDTFRGHDDDKRRKKNRQRLLLVRDYEKPEFTPRDLTQTSQLVRLGAQVLKKGFTGLERQPVITSMPGSVTGVMRKGWNLIGCLSAANPNVLDEIGQPKIKTEIRDITHLHHALDACVLALVSHFIPNNGGVWELIVKRRLDETEQLQLRAATHGIFNFSPGRRFGLADLPDSLKEQIRQRLAERRVVQHVPTEMTGLRVEQNAWRVVGIADGEALLRQRIRQPDGSRPVKEKRERTEKLIGPEPHNGTGKLKRNKAALIIPDNYGLALDPEPTIIPFHKVWTRLQDLKGANNSKTPRVLRNGQLIRVAESAGEYKGIWRVFSTKNAAVGFLVDMGRPDVVRLKNGVEGHKINVRLSSLLKHGVELVRSNYAGMAACPSTLSA

SEQ ID NO: 330 - protein, 1077 aa, unidentified
  REGION 1..1077: note = Description of Unknown:uncultivated organism with predicted taxonomy: Verrucomicrobiabacterium
  REGION 1..1077: note = MG2-14 effector
MSLALSFDIGHSSIGWAVLDVKGKDPEIVGCGSVVFPAEDCQNQQRASFRRQRRHIAATRNRIKRLEAFFVASGVLSEKDIWECRRRPHPWPWLLAARTIVSGQTLSGVELWAVVRWYAHNRGYDGNALWAGEDSNQDDVMKVQAARQLMDKCGTETMCETICSLLEADPRSDSNPKPKHYFKGENAAFPRQTVTDEARSVLELHIAKIDGVNEAFVSALVDEWRRAKSAGFDVKLPQRYCGGLLFGQLKPRFENRIIPKCRLTGEKTPSKHSREFYRYRWAMFLNNLRVHDLMTGFSRPLDSNERVKLDGIMREAGYFTKTTLTKALVKELQLEPANLEAMLLLPEMENALTLDPALREVSTNKILKTIWPCVDNVWQRVFLNQLFHERRFRGQPVSLNQWRDRLLSDGKSVEDFDKALQSAFETEASFLWNKKNLKVTFEQFLSRPICLTSKHVASGRAPYSKSKLRAAVDAVMQGEDPRMIGGPLEETIEVGQRQRDKEIDQNSNNHLVRHRLKIFARTLNDLVARYASGDASRVNWFAVEVVRDLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDTRGESHTFSPKEFREFVGGLKNKNGPAKDDEVRCKKRKIALLTPIYERRGKVKQTDTGEEVLEAFTDGTLSQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNPRTMRGLRVQQNVWRVEGEDPQDDSKLLISMRPRNEEGSKGFSKQRSEKKSKLLGPSPNIGSGKLKELKGALIVEDNFGLALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 331 - protein, 1079 aa, unidentified
  REGION 1..1079: note = Description of Unknown:uncultivated organism with predicted taxonomy: Verrucomicrobiabacterium
  REGION 1..1079: note = MG2-15 effector
LRMSLALSFDIGHSSIGWAVLDVKGKDPEIVGCGSVVFPAEDCQNQQRASFRRQRRHIAATRNRIKRLEAFFVASGVLSEKDIWECRRRPHPWPWLLAARTIVSGQTLSGVELWAVVRWYAHNRGYDGNALWAGEDSNQDDVMKVQAARQLMDKCGTETMCETICSLLEADPRSDSNPKPKHYFKGENAAFPRQTVTDEARSVLELHIAKIDGVNEAFVSALVDEWRRAKSAGFDVKLPQRYCGGLLFGQLKPRFENRIIPKCRLTGEKTPSKHSREFYRYRWAMFLNNLRVHDLMTGFSRPLDSNERVKLDGIMREAGYFTKTTLTKALVKELQLEPANLEAMLLLPEMENALTLDPALREVSTNKILKTIWPCVDNVWQRVFLNQLFHERRFRGQPVSLNQWRDRLLSDGKSVEDFDKALQSAFETEASFLWNKKNLKVTFEQFLSRPICLTSKHVASGRAPYSKSKLRAAVDAVMQGEDPRMIGGPLEETIEVGQRQRDKEIDQNSNNHLVRHRLKIFARTLNDLVARYASGDASRVNWFAVEVVRDLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDPRGESHTFSPKEFREFVGRLKNKNGPAKDDEVRCKKRKIALLTPIYERRGKVKQTDTGEEVLEAFTDGTLSQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNPRTMRGLRVQQNVWRVEGEDPQDDSKLLISMRPRNEEGSKGFSKQRSEKKSKLLGPSPNIGSGKLKELKGALIVEDNFGLALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 332 - protein, 1137 aa, unidentified
  REGION 1..1137: note = Description of Unknown:uncultivated organism with predicted taxonomy: Verrucomicrobiabacterium
  REGION 1..1137: note = MG2-16 effector
MKTSHSSPDLELAFDVGHGSIGWAVLQNGSQTQIKGCGVVIFRPDDCLASKRREFRRQRRHIRSTRQRIKRMKLLLAHLGVLTQEQLDKPGCAWPWKLAAQVLVGGPTLTWPELWDVLRRYAHNRGYDANRRWSTIEIDLDEEQEDTEKLKTAEGLLKKHGVRTMAEAFCKELGVDPLGSKCASKVWFKGVNAAFPREVVEAEVRSILRAHFGKLKAVDELLEKALCDDWRAIECPAIRLPKRYEGGLLFGQLIPRFNNRIISKCPITGKKVPSRNCPEFLKFRWAMLLANVKVAGTADRELRPLTVAERQAVDAKMREKGALTAEEFKHAVRTASGCSRDNLDAMLMHPDAHEALLLDPVQRELSRDELIAALFAKLPVRIQKRARGQLRRGKTITLGQLRDQAIALGESVEAFDNELNRLLEAATIRRRRKKDAALTAESVLKRSLYVEKLTGRAPYSREILVKAYEEVMAGKHPAEEGGCLFVTDQMREAQLQREIDEQTNNHLVRHRLKILDRLLRDIITEYAGNDKTRIAKITIEVNRDLREMSGKTAKEKAQYFRLLTADHHRVAEKLKKALAGQTVDGKPIRISASRIRKARVAEDLNWTCPYTGQKYEPIDLVTERVDEDHIVPRSQRMSDSLESLVISFSAVNKWKGKRTAMRFIKEEQGKPVPGLPNLSIVSLNRYLEFVDSLPPRNDPRKLKRHLKLLQPIDDDLRKWRRKELLKLEEYEQEEFTPRDLTQTSQLARMAAQMVKRTFQDVEQKPVIVSMPGSVTSTVRKGWDLLGCLSKACPEVLDETGQVKTKSEIRDITHLHHALDACVLGLAAHFIPNNGDIWKLIIKQDLNETEKDLLRPLGIFDIGEKRFRLKDLPNELKNQLRERLAELRVVQHIPKRMTGMRVDQTVWRVFDPQDQHPSARRLARWFKKAGVNVPAPDADTVLIVCRKRRSQPDSETGKTLHETKTWRWVYQEIAKSKLIGLQPRPGSEGRLKKLKAVKILADNYGVALDPEPQIIRFHKVWPQLNELRQKNGSKPVRVLRNGQLIRVPRGTYAGIWRIVSTKSTEAFGLALDLALPDRVKLTRGNVPIKRLIEDGLEVVDCPYTGVDASKIEFAPVKKRPRKSKTAPAETTTPPSSSA

SEQ ID NO: 333 - protein, 1471 aa, unidentified
  REGION 1..1471: note = Description of Unknown:uncultivated organism
  REGION 1..1471: note = MG2-17 effector
MGNRADLELAFDVGHSSIGWAVLKTQPELEMKGCGTVIFRPDDCLASKRRDYRRQRRHIRSTRLRIERMTNLLLGIGAITQSDVESGKKQHKGEPPPWLLAARVLAARTETEKAKALLTWPELWKVLRWYAHNRGYDANVRWSGESKVEAFSPSPQINTEDVEEQAVEAEESELADVEVAEDSDSDSDKLRAGKHLMSSKYGFHTATFAETVAKILLGPKRDVKPGQAGKTGKLAETTESFSESDFRKLLFDTPTESWSHPRHLSIYFKGIRAAFPRRIVKVIGGQRTLVGGTEWEVRAILRAHFDAPKGKALCDETFEAAICGRLPETREDWRAYAETHPTLYLSSDDQAKLRSLRAPPKASQEKSERIRQQRRNILTGKLFLPSRYEGGLLFGQLGTRFFNRIISRCPFSFARIVAAILSGDENTLRLYGTTLAAVNRSRHSRNGVMETDLDLARRWAAKLSKVPAAKSREFLLYRWAMTLANVIVARPGRERLTGYERRCIHRRLRRTGYFTKDSFKEAVRQTTGCEPANLDQMFDTTTEAENSLFIDPVRKYLATNEVAGVVLPVLSQFLQVRLARLLQKGKGVRVREIAEWLDETAKRELSQRIEQYVQENNAKAKAAKKKPHDTHSPDEDRRKKQNKLTAAAVLRVRLEAPLPKGRASYHRVVLRKAVAEVLKGFDPRKPKRDRSNPDGENKPSHGCLFRTPETNRQLLGNPNNEAEYERWKQRWLSHQKNYQRYIARERLSPGSGEAFVRSEYHAAQSYRWLASQSNNHIVRHRLTILDRLLRDIIADQNYCAGDPKRIRRISIEVANDILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDLTITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTPADMSGLAAEETVWRIFDPSDNHPSARRLKQWFEKKIKDGEIQKLPDPTNEADKTVLIVCRKRRDAKSNDKGKTLHDTGNVWRWVYDEVNKVRVVGLNPGKLHRIKAVKLIRENFGIALDPEPTIVPFHKVWQRLMELKAKNGGKMPRVLRNGQLIRVLSGSRAGLWRVTSVKQTEAYGLVLDLAYPDSVHLSRPNAPVEQLLKEGLEILKHSLTGYDASVVAYAPVKRRPRKPKAAQSEQ

SEQ ID NO: 334 - protein, 1003 aa, unidentified
  REGION 1..1003: note = Description of Unknown:uncultivated organism with predicted taxonomy: Verrucomicrobia
  REGION 1..1003: note = MG2-18 effector
MKTLLRHLGALTQEQLDKPGCAWPWKLAAKVLVSNGAHTLSWPELWDVLRWYAHNRGYDANRRWSGAEVDAQEEQEDAEKLKTAKNLLQKHGVQTVAETFCKELGIDPLGQKSASTVRFKGLNAAFPREIVEEEVRRILRAHFGKLKGVDENLERALCGRDSRDKDAWQAIPCPDIHLPERYEGGLLFGQLVPRFDNRIISKCPITGQKVPARNCREFLEFRWAMQLANVKVAATGNGPLRPLTADERRQVDTKMREKGALTPTEFKEGVRVATGCVRDNLETMLMHPDAREALTLDPVQKALTSDERIAALFAKLPARIQKRARGQLRRGKTITLGQLRDHALAVGESVTDFDEELGRQLNAAAAKKRKKDAGISRESLLARPLHVEKLSGRAAYGREILRKACEEVMAGKHPKEEGGCLFVTEQVRQAQIQRDIDQQINNHLVRHRLKILERLFHDIIAEYAGGDKSRIGRITIEVNRDLREFSGKTAKEKAQDLGLRIADHHRVAEKLQKALAGQTLNGQPIRIGPALIRKARIAEDLGWTCPYTGQKYEPIDLVTRRVDKDHIVPRSQRASDSLDSMVITFSAINKWKGKRTALKFVEDEQGKPVPDLPNLSIVSLSRYRDFVEKLDTFKGHDQDKKRKKRRKALLLVRDYEEEEFTPRDLTQTSQLVRLGAQMLKRPFLREKHQPVITSMPGSVTGEVRKGWNLLGCLSKACPQVLDENGEVRTKTEIREITHLHHALDACVLGLAAHFIPNNGRIWELIVKRNLTDTEKLQLRALGIFDFSPEGFRLKELPDELKNQIRERLAERRVVQHVPKRMTGLRVEQNAWRVVKIEGDEAIIRQRMRQPDGSRPVKETTERVTKLFGLNPVGGSGKLKALKAALIIPENFGIALDPEPTIIPFHKVWPRLQELKKANGGKWPRVLRNGHLIHVPKGRYQGTWRVFSAKNNKSGMAVDMGWPDVVRLRNGVQGHKINVLLASLLRDGMTILDTPLTGVASPVR

SEQ ID NO: 335 - protein, 1125 aa, unidentified
  REGION 1..1125: note = Description of Unknown:uncultivated organism with predicted taxonomy: Verrucomicrobia
  REGION 1..1125: note = MG2-19 effector
MQEKILSTKDGGKNLEVSFDVGHSSIGWAVLKSPDKNGENNPEFPQIELLGCGVVTFEPDTCLAKKRRDYRRQRRHIRSTKMRIKRMKQLLEHLKVLTPSELEKPGSPYPWKLAASVLQGKHLLNWNEIWDVLRWYAHNRGYDENRHWSEVAEKDKDDTESVKKSIELMKEHQTKTMAETICKELGTDPSESDKRASHKSYKEVGAAFPRSVVVNEVREILDKHIGKLPGLSQELVETLVGESKDAWKTIPCPSINLPSHYWGSLLFGQLLPRFNNRNIKKCPFSGDTLPLKECVEFYRYRWGKILTNIRVSANGLFGQKRPLNPEERKYVDSKMRELGSMTETELQKAVEEAVLMTLNKEGILKPGKINTNLETMFLTPEMEKGLVLDPVKNLINSDTVQSFWGVLPPQLQKRLTGKWRRGKQIKIGEIQKELEKIAPEKVEEFISTIKKNLKGKNKNQNYLEIKIPDSPLKQLKGRAPYGRKLLQQAYEEVLEGKDPHEKGGCLYRAENILKEEIQEDIEKQTNNHLVRHRLLILERLFDDIVKEYAGNDKNKIKLITIEVNRDLREFSGMTAKEIESELNARSADFKKAKKQLEDMLLKAGLSNTRITATLIKKARIAQDLDFTCPYTGAKYELIDLINKQVDLEHIIPKSKRPSDSMESLVITFKEVNRWKGNRTALRFIKEEQNKPVQGKGNLMILTEKRYQELVNGLNTKGHPKDTERKKKRKELLLMEDYVEEEFLPRDLTQTSQLVRLAVQVLKKKYIGEKEKPVFVSMPGSITGKFRAAWNLLGCLLKAVPWAADEDNQVKPKDELRNITHLHHAIDACVLALAGHFIPTYKNGKVWELMIKGTVKPSEKSYIEDVPMLQLDSENRLHIKDLPDSIKEQITERLYERRVVQHIPKDMSGVKCDETIYRVVDPNDNHPYAKKLIRWAKEKDIQIPSADDDTALIVAKKRRGADGATGSKILHEGKKYVWQYDIVRKTKLLGIEPIGGNGKLKRLKAAKLIGENYGIALDPKPQIIRHFKVYQTIRELKKLNNGKPPRILRKGSIINVPKGRYKGVWKITSIKDSKDEIKVNILRPQAVKNVGKTNYSKGDVLLRTLIKNGMQVIEAPYTGVNVALYS

SEQ ID NO: 336 - protein, 834 aa, unidentified
  REGION 1..834: note = Description of Unknown:uncultivated organism with predicted taxonomy: Verrucomicrobiabacterium
  REGION 1..834: note = MG2-20 effector
AARQHLTELAARQGAFTKGEFKKAVREAAGWPEKGGHDNLDALLLHPDAEEALVFDPVQAALRKHPLAEAFLTLPPQFLKRLRGKLARGKSVAPGTVRDWLSRAQAPPPSASDPLAAFDAAIQRVLDAANTRKGRKQSALTREQLLEEPLRATYPKGRAPYARPVLRQAYEEVMKGWDPRAEANDHQPRGCLCQTDELKEAQLQRRLEEQTNNHLIRHRLLILGGEQPKPNATPEHERRRLKGLLHDLIQDFANGDKSRIASLTIEVNRELRDLSGKTRKEQEQDLGLRLGDFKRVAAKVEEACRRRGIPCTAGLIRKARVAEDLGWKCPYTGKEFSVDTLLDGVMDKDHIIPHADRQSDSLDSLVITWNEVNKWKGKRTALEFIREEGGKPVPGRPELTVMTLAEFQKHVASLDIRKGHDDDRARKKRRIRRLLTEYYEEKEFTPRDLTVTSHLVRLGAQVLQRAFPPEQRPPVISLPGSVTGEVRKAWKVTACLEAANPAVMEVVEEPDPQTGEMRRIRRAKKKEDIRGITHLHHALDACVLGLASLYFPRHGAVWSAAVKAGQHAATEYDNNEHPLWQAMTKRRPTAQEVVLLKATGLYDGPDSNGRMQLRDLPAELKGQIRRRLAEKRVVQHIPADMSGVKVEENTRGVVAVKDGRVILRQRSARDAKTGLQAVKTTDEAPGKLLGLNPPGGDGKLKRQKGVRVITDNFGVAILDHAPEGEEKFVVIPWHRVWHRVEELKAANGGQRPRLLRNGMLIRVAGLPGKMASKNGVWRVFSVKQTKKLDLGGPDRVAMEDKGLGVWREVSLETLTPARIAILRHGLAGGPQPDP

SEQ ID NO: 337 - protein, 1129 aa, unidentified
  REGION 1..1129: note = Description of Unknown:uncultivated organism
  REGION 1..1129: note = MG2-21 effector
MQEEILNTSDVSKNLEVSFDVGHSSIGWAVLKSPDKNKMNNPEFPQIELLGCGVVTFEPDTCLAKKRRDYRRQRRHIRSTKMRIKRMKQLLEHLKVLTASELEKPGSPYPWKLAASVLQGKRLLNWNEIWDILRWYAHNRGYDENRHWSEVAEKEDEDDTESVKKSIELMKNHQTKTMAETICKELETDPSESDKRALHKSYKEIGAAFPRSVVVNEVREILEKHIGKLPGLSQELVETLAGESKDAWKTIDCPPIKLPSHYWGSLLFGQLLPRFNNRNIKECPFSGDTLPLKECVEFYRYRWGKILTNIRVSADGLFGQKRPLNPDERKYVDSKMQELGSMTKTELRKAVEEAVLMTLNKEGVPQPVKINTNLETMFLTSEMEGGLVLDPVKKLINSDTVQSFWGVLPPQLQKRLAGKWRRGKQITIGEIQKELEKIAPEKVEEFNLAIKSNIKRKKKTENHLNDKIPESPLKMLKGRAPYGRKLLQQAYEEVLAGKDPHEKDGCLYRTENILKKEIRKAIDKQTNNHLIRHRLLILERLFDDIVKEYAGNDKNKIKLITIEVNRDLREFSGMTAKEIESELNARSADFKKAKKQLENMLQEAGLSNTRITATLIKKARIAQDLDFTCPYTGAKYELIDLINKQVDLEHIIPKSKRPSDSMESLVITFKEVNRWKGNRTALRFIKEEQNKPVPGKENLMILTEKRYQELVNGLNTKGHPKDTERKKKRKELLLMEDYVEEKFLPRDLTQTSQLVRLAVQVLMKKYIGEKEKPVFVSMPGSITGKFRAGWNLLGCLLKAVPWAADEDNQVKPKDELRNITHLHHAIDACVLALAAHFIPTYKNGKVWELMFKGTVKPSEKMYIEDVPVLQLDSENRLHIKDLPDSIKEQITERLYERRVVQHIPKDMSGVKCDETIYRVVDPNDNHPYAKKLIRWAKEKDIQIPSADDDTALIVAKKRRGADGATGSKILHEHKGKTKYVWQYDIVKKTKLLGIEPVGGNGKLKRLKAAKLISENYGIALDPKPQIIRHFKVYKTIQELKKLNNGKPPRILRKGSIINVPKGTYKGVWKVISIKEGYSEIKVDILKPQAIKIVDKTDYCKREVLLRTLITSGMQVIEAPYTGVNVALYN

SEQ ID NO: 338 - protein, 1471 aa, unidentified; identical to SEQ ID NO: 333
  REGION 1..1471: note = Description of Unknown:uncultivated organism
  REGION 1..1471: note = MG2-22 effector

SEQ ID NO: 339 - protein, 778 aa, unidentified
  REGION 1..778: note = Description of Unknown:uncultivated organism with predicted taxonomy: Verrucomicrobiabacterium
  REGION 1..778: note = MG2-23 effector
MQLANVRVAGSGNGQMRPLTADERRRVDAKMREKGALTPTEFKDAVRSATGCVRDNLETMLMHPDAKEALTLDPVQKLLTSNECIAALFAKLPARIQKRARGQLRHGKTVTLGQLRGYALAVGESVADFDEELQQQVDAAATKGRKKVAGVSRESLLAQLLRMEKISGRAAYSREILRKACEEVMAGKHPKEEGGCLFVTEQMRQAQIQREIDQQTNNHLVRHRLKILERLFRDIIAEYAGGDKSRIERITIEVNRDLREFSGKTAKEKTQDLGLRVADHHRVAEKLQKALAGQTVNGQPIRIGPGLIRKARIAEDLGWTCPYTGQKYEPIDLVTRRVDKDHIVPRSQRMSDSLDSLVITFSAINKWKGNRTALKFVEDEQGKPVPDLPNLSIVSLSRYREFVEKLETFKGHDDDKKRKKRRKALLLLRDYEEEEFTPRDLTQTSQLVRLGAQMLKRPFLGEKHQPVITSLPGSVTGVVRKGWNLLGCLSKACPQVLDETGEVRTKTDIREITHLHHAVDACVLGLAAHFVPNNGRMELIVKRNLTETEKLQLRALGVFDFSPDGFRLKELPEGLKNQIRDRLAERRVVQHIPKRMSGLRVEQNAWRVLKIEGDEATIRQRVRQPDGSRPLKETTERITKLFGLNPTGGSGKLKALKAALVIPDNFGIALDPEPTIIPFHKVWPRLQALKKANGGKWPRVLRSGQLIHVPKGRYQGTWRVFSTKNNKSGMAVDMGWADVVRLRNGVEGHKINVLLASLLRDGMTILDTPLTGVASPPL

SEQ ID NO: 340 - protein, 1074 aa, unidentified
  REGION 1..1074: note = Description of Unknown:uncultivated organism with predicted taxonomy: Verrucomicrobiabacterium
  REGION 1..1074: note = MG2-24 effector
MTAKQNLADLHLAFDVGHSSIGWAVLRHTPPPALPEILGTGVVIFGADDCLASKRRQYRQQRRHARATRKRIELLARFLFHRLQGETDPATTQFREHLKPYLEQTAATRQLQGDGDSFAWQRAAEILTAARENKPLPDLGWSELWDILRWYAHNRGYFAPPWANRGDESAAPDTDDEVSDTEKVEHANDLMRELGTRTMAETVAAYTARYEREAAEWQQGRRKEKPKHFKGLNAAFLREKIVWPEVCALLTALKGRLPGLDDAFIRTLLGNDVDPLRDRDAWRTIPCPDIQLPKRYHGGLLFGQVIPRFENRIIGVCPIWFSVCQDLCLHHPEITQDDPLRREKEAVVQAFEQWLPRAKKANERLSPEKQKSPEALIAEFAAKQSKLPAKASPEFLRFRWAMQLANVFGAAPGERETRPLTADERKQLTARAEKQGAFTKGEFKQAVREIAGWLEQSSRDNLDALLLHPDAEQALIFEPVQAALRKHSLAEALLALPPQFLKRLRNKLTRGKEVKPQAVRDWLGGAQASTPSASAPLAAFDAEVQRVLEAAATRRAKKQTALTRDTLLAQKLCATYPKGRAPYARPVLRQAYEEVMQGWDPRAEKRADQPRGCLCQTDELKEAQLQRRLEEQTNNHLIRHRLLILERLQRDLIAAPEFANGDKSRIAGMTIEVASDLRDLSGKTRKEQEQDLGLRLGDFKRVAAKVEEACKRRNLRVTAGIIRKARVAEDLGWRCPYTGKEFCIDTLLDGVMDKEHIIPHADRQSDSLDSLVITWNEVNKWKGKRTAMEFIREEGGKPVPGRPELEIMSLAAFQKHVASLDTRKGHDDDRARKKRRIRRLLTEHYEEKEFTPRDLTVTSHLVRLGAQVLQRVFPKDQRPPVVSLPGSVTGEVRKAWRLTGCLEAANPAVMEEVQERNPDTGELQTVRRPKKKDEIRGITHLHHALDACVLGLASLCFPRHGAVWSAMVKAGGDREADDDRRLWLAMTKRRPTPQEATLLKATGRYQQDSEGRLHLADLDEQLKQQIRARLAEKRVVQHVPADMSGVKTEENTRRVLRVREDGRVELRQQAPRDA

SEQ ID NO: 341 - protein, 1337 aa, unidentified
  REGION 1..1337: note = Description of Unknown:uncultivated organism
  REGION 1..1337: note = MG2-25 effector
MGTPTLSSDPNAKLELAFDVGHSSIGWAVLRPVAADVRRLTSTPAKESSQSLVTSAATGIELLGCGVVTFGADDCLASKRRDYRRQRRHARSTRQRIARMEKLLAALNVIPKAELERLHSQAKGHSKQNPHERKGASAPWLLAARVLAARTEEERKKAELDWPELWDVLRWYAHNRGYDGNIRWSGGFRVEAFSETPQVSVSALTEQVDKAKQNEDDPDEDWKKLESAAKRMADYGFTSPTFAEMVAKYLLGPDRTLKPAQPGKPAEVEPTKASFTEADLHKLLFHCEPGFEHHPRHLSNYFKGLRAAFPRRIIKDIDGKPTLVGGTEWEVRYILRAHFGTLTGCDARFEQVVCGGIPEAETDWLALGELLPALYLSDDQKRQLKALRIPKDAFAGDKPGRKREKERLRFLRTAITRDKLVVENRYSGGLLFGQLVPRFDNRIITRCPISGDKVPVKQSPEFLRYRWAMQLANIQVAASAQEKLRKLTADDRAALHKLMQAKGALTEGELKKAVRALPGVARDNLDTMLMHPDAKDALIFDPVQKLLASDELAPFWATLPANLQARFRGKLRHAKAITLADLRTALPDPKAFDVELQRQLDAQNTRKAKKQPAFSRDQFLAQSFDARKALARLSGRAPYARPLLQQAYEQVLAGKDPREEGGCLFRSEEIRQRELHKKLEDQTNNHLVRHRLLILERLLKDLVNAPEFAAGQPERVAQVTIEVNRDLREFSGMTRKAIEMDLGSRLKNFKSVSDKLEKAFDSQTYNGKPVQVTAGLIRKARIAEDLGWQCPYTGQSFEPVHLVSRAVDKDHVIPRSQRPSDSLESLVVTFSEVNKMKGQRTAWQFIQEFGGKPVEGMPNLMIRTPKQFEEFVTKLESFKGHEDDKRRKKRRKDLLLLPKFEDKGFVPRDLTLTSQLVRLGAQVIKRFFAGGARVNNPREAPTDSTARGFVNPRSGPRITSLPGAVTGAVRKGWRVLGCLAQAAPQILEPTGEPKSKTDIRDLTHLHHALDACVLALAAHYFPKDGSLWEAMIVRAPNAAQKQLLHATGFYEFIAEDKPNLKDLPIELKQQIANRLAEKRVVQHIPADMSGMKVEENTRGVVKVENGRATLRQQKRNAEGKLEVKETEEVVGKLVGLHPEPKREAHPSPALRAPSPLAGRGEREESNDAAAGSPPSPFAQRGERDGVRGAAQGKLTPMRGVRVITDNFGVAILDHASNPDDRFVIIPWHKVWHRIEALKEKNGGQPARVLRIGTLIRVPNKSGRSDYRGTWMIRGAQLNQNAGMLVDLSNPDVITYRVSGRKDCKQNVSLKSLVEGGLEILKPSLCGVAQTAQAMAPG

SEQ ID NO: 342 - protein, 853 aa, unidentified
  REGION 1..853: note = Description of Unknown:uncultivated organism with predicted taxonomy: Verrucomicrobiabacterium
  REGION 1..853: note = MG2-26 effector
QRLAKGASAAEATAHARKLAKVPSRNCPEFHRFRWAMQLANVQVASGRSPELRPLTVPERRQVHARMLQRGFLTAAEFKKAVREITGATRDNLDQMLMHPDAQEALILDPVRRLVTTSPILEAVWPQLPEAAQKRAAGQWRRGKTLTLQDVVRHTNAAERARIEAAVKNHLDLENTRRKKKDKTLRADEIMTQPLSIKRLSQRAPYTRVVMDEVWADVMERGLHPKEKGGCLYRDEAIRQAQLQREIDEQTNNHLVRHRLRILERLHRDILQEYAQADPARVARVTIEVNRDLRELSGKTRKEQEQDLGQRLANFKSVVRKLEESFDGKKVKITPGLIRKARVAEDLGWTCPYTGKAYDAFDLLNRAVDKDHIIPRSQRASDSLDSLVITFAEVNKMKGKRTALRFIEEFQGQPVPGAPRLSLRTLRDYQQWVEGLETFKGHPDDQRRKKQRKKLLLLPEYVEKDFVPRDLTQTSQLVRLGAQVLQRAYLGLARPPVVTSLPGSVTGTVRKGWDLLGCLATANPGVLDESGEVKNKTEIRDITHLHHALDACVLALAARAIPNNGRVWELLTRRDNGLNEVERQQLLALGIYARDSEGRLVLRDLSPDLNEQVRQRLAERRVVQHIPSDMTGLAADQTVWRVFDPADSHPSARRLARWFKEAGVKVPPAGADTVLITCRKRRSQAGAETGRLLHQSPTWRWIYQEIPRSKVIGLEPRPGSPARLQRLKAVKILGDNYGLALDPEPQVIRFHKVWSQLQELKRRNEGKPVRVLRNGQLFRVQNGRYRGIWRVFSTKDNSSGMALDMGYADVVRLRNKTEGHKINVLLSTLLRDGLCILQSSYIGVSTCPTTSSA

SEQ ID NO: 343 - protein, 1016 aa, unidentified
  REGION 1..1016: note = Description of Unknown:uncultivated organism
  REGION 1..1016: note = MG2-27 effector
MASLEFSLDVGHSSIGWAVFQSDPFQPLGAGSVIFGADDCLAKKRRDYRRQRRHIRSTRQRIERMKQLLSHVGFLTREQLDQPGTAWPWLKAAEVLKPEGGVKLSAQELWDVLRWYAHNRGYDGNRAWARDETEAQEDTAREQAARQWMQDHNTQTMAETVCAVLDVGPGKRSDGGDKRSSNLRFKGRGVAFPRSVVTSEVRHILENHQGKLPGLDSRTIRILMDDARHENLAAEAGIRLPHRYEGGLLFGQLIPRFDNRIISSCPVTYEREYARALDEGKSEDEAKHQAVRQAKVPAKKSREFLLFRWAMILANVQVADASGTRPLSVEERQSLHQLMVKSGKLTKREFLKTLDATVGSPRHNGSALLMPPDADKALVLRPEKDALKRLSGRAPHARVVMKQAVKDVFAGRHPMAEGGALFRSEELRALQLRRTVEEKTNNHLLRHRLLILRRLVKDMLATYAGNDPSRISQVTIEVNPDLRSFSGMTAEEKKQEMGQRLGDFKKVVQKLRGDLPEVTAISAGLIRKARIAQDMNWTCPYTGMEYDALDLLHGHVDKDHIIPRSLRPSDSLDSLVLTLRTINEMKGQRTAVQFIKEFEGREVQDGKKRSLEILPWSQFQKLVESLDAKGIHDQDRARKKRRKALLLQEHYTEKEFVPKDLTQTSHLVRLAAEELKKEFGGVQCSTRIVSMPGSVTAETRKAWKLEACLAQANPEVAELRERRKTEPAPVSIKQELRDISHLHHALDACVLACAAHYLEKKGNIWKALVQRRKSEAENLELLSTGLFKRGQDGQARLQDLPAQLKNQISRVLAECRVVQHIPSNRRGLKAEETVWRVLDSEDHHPSAEKLRKWAQLAQVELPNPDSGKVLLVKRIRHTAAGAKAPKNLLHQGSEFWWAYEVVALSKLVGPGASGKLRKIKGAKQIGDNFAVTLGPKMEVIPHHQVQERWKGLGCPRYLRNGQIIEMPTGKYSGAWKVFSIKNARQGILLDIARADSPRAKQGNPGTRINVLLKTLV

SEQ ID NO: 344 - protein, 1081 aa, unidentified
  REGION 1..1081: note = Description of Unknown:uncultivated organism with predicted taxonomy: Verrucomicrobia
  REGION 1..1081: note = MG2-28 effector
MTTQRNSSPNASRKFGGQLAFAFDVGHSSIGWSVLTAPERDHPEILGCGVVLFEKDSALACQRRQHRRQRRHIRATRQRIARMEKLFMHIGALTREVIESKHRAGGGNSAPWLLAARVLASNGQKTLSWQELWDVLRWYAHNRGYEPVSDEAEADKEDIEKVENAKREMGRLGTVTMAETITAWLGLDTFGKRAASRENYKARNCAFDRGMVVAEVRRILEAHVDRLPGLDERVVKAILDDVHAIEVPSIRWPRRYRGGFLFGRLATRYHNRIIGKCPISGAKLPKKRCREFLCYRWAMLLANIRVVDSDDGRSRPLSREERSNIHKSMERKGYLTPGDLKRLVGTLPGVKQHNVDQIVVHPDAGEALVFDPIRKLIVSNERVAAVWETLPPQVKKRATGKWRRGKSLNLAALRAEVVELGHDVSGFDSAVTTFVSSRQKTRRRSRTHSKETVDDIIEAPIDARRDLAKLSGRAPYARQLLDQAFKEVMDGKDPRARGGCLEETEEVRRRREERPIAEQTNNHLVRHRLQILGRLLNHLIEDPAYGANRPERIRRITIEVNRDLREMAGRTSQEIAKELGARVANHKKVANRLFGELPEGTRITGSLIRKARIADDLGWRCPYTGVEFEPVDLVEGRVDRDHIIPRSQRMSDSLDSLVITFSAVNKWKGQRTAWQFIQEEGGKPVPDAPNLSIVTPARFRDFVEHLDTKGHRDDYRRKKRRKELLLLERYEERTSGFTPGQLTQTSQLARLAAQILRTPFNDTSNPPEIVSLPGFVTATVRRSWDVLGCLSQAAPGVLNTDGSTRSKTEIRNITHLHHALDACVIGLASHFIPNRGDVWRLLAQRNLRAWEKQQLADLGVFDFDAHGGLRLRDLPQQLKEQLRQRLTERRVVQHVPADMNGMRVEENTRGIVRREDGRVYLRQKTLTSDGRRNVKNSDELDIMVVGLNAGGKLAELKGIRVVKENFGVAILENTSLPSGDRFVIIPHVRVWKQLQELRMRNGGKPPEVWRKGQIVRIPSGNREGKWRIFSVMASNRGIMLKLDRPDSPSFDDSGGASGFKMTLTSLIKRGTIRLETRLTGS

SEQ ID NO: 345 - protein, 1026 aa, unidentified
  REGION 1..1026: note = Description of Unknown:uncultivated organism with predicted taxonomy: Verrucomicrobiabacterium
  REGION 1..1026: note = MG2-29 effector
TVTFESDGCLASKRRVHRGMRRNIRSRRLRIADIEKLFVHQGILSADQIAEKHKPGAGSSSPWLLSAAVLASGGTFVLNAEELFDVVRWYAHNRGYDGNRRWAHNAEDDDGDSDREKAAFSLMDAHHTSTMAETICAQLGLMPGGQKKASMAPYKDSDIGAAFPRKTVVAEVVRVLEAHVGKIEGCSAEFIEALCGENDGAWKTIAVPNLGKPKTFKGGLLFGQKVPRFDNRILPFCPVTNKPTPLKSCIEFMEFRGAMFLSNVRVGSGDGFELRPLSADELNVVWDKIHKKGYLTSRQFKDEIRGLEGVEKDNLQALMTIDSADKNLVVDPALKLISSSTVLKPVMSLLSEASREELLSNLRRKHGVTISEMISDLSISEELTKAIDTSFKKESKKKREKYGTQERWLSERVFSAEFDSGRAPYGRLVMKQAVEEILSGKDPRAKGGCLYLTDEMQKRQESRSLESLTNNHLVRHRLLILKRLFNDMVKEFCEDDKGRILSVVVEVNREVSSMSGKTMKLIKMEEGLKRSDHKKASKIMEAAVEESGENIRVGAGLIRKARVAQDLDWTCPYTGEKFDPLALIHSQVDLDHIIPRSERLSDAMAGLVVTFSEINRWKGARTAYQFISEEQGKQVPGKPNLSIMSLKAYEDFVGKLKISGGHDSDVGRRKARKGYLLLASYQDKEFTPRDLTISSYVAKLAVGQIKKEFSELSKKPPVISLPGRLTGEARKSWKLLGLLSAVNENITSETPKNDIRGLTHLHHAMDAAVMGLMAHCADNLSDGTSWQLLLKRNLRPEEKNLLKANMRNIGFDGNRAHLLDVPNEIKEQLRRCLLERRVVQHVPSSMEGLKVEENTRGIVAFNEERKKVTLRQTGNETEEVSGKLLGYKTEGSKLADQKGVRVINQNFGVALTHPPQIITWHKVYPKLKKIEQETGRWPQVLRNGMLIHVPEGNYAKASKIWKIFSLKNNASGMAVDMGYADSVKPVKINVLLKSLIKDGLQIIGSDFSGEGICHITSSTLEAQPSD

SEQ ID NO: 346 - protein, 1065 aa, unidentified
  REGION 1..1065: note = Description of Unknown:uncultivated organism with predicted taxonomy: Verrucomicrobiabacterium
  REGION 1..1065: note = MG2-30 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNACPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVFKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVPSNMGGMHVEENTRGIVGFDSEKGKVLLQQKKDGLKNITTEVAGKLLGYDAEDGSKLKKQKGVRVINKNFGVALTQSTPEIITWHKVYPKLSSIYKRDGVWPNVLRNGMIVYIPDGNYAKVSKVWRILSIKNEKRYMAVDIGFPDSCKSVKRSVNLTTLLKDGMKIVYTKLTGDGICHITSSKSIAPPFD

SEQ ID NO: 347 - protein, 1062 aa, unidentified
  REGION 1..1062: note = Description of Unknown:uncultivated organism with predicted taxonomy: Verrucomicrobiabacterium
  REGION 1..1062: note = MG2-31 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNAYPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVLKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVPSNMGGMHVEENTRGIVGFDSEKGKVLLQQKKDGLKKITTEVAGKLLGYDAEDGSKLKKQKGVRVINKNFGVALTQSTPEIITWHKVYPKLSSIYKRDGVWPNVLRNGMLISVFSGRYAGIWRILSIKNNATGINFSIAKPDAIAPFKQNVLLKSLMSAGLKKVETKLTGDGICHITSSKSIAPLFD

SEQ ID NO: 348 - protein, 1062 aa, unidentified; identical to SEQ ID NO: 347
  REGION 1..1062: note = Description of Unknown:uncultivated organism with predicted taxonomy: Verrucomicrobiabacterium
  REGION 1..1062: note = MG2-32 effector

SEQ ID NO: 349 - protein, 789 aa, unidentified
  REGION 1..789: note = Description of Unknown:uncultivated organism with predicted taxonomy: Verrucomicrobiabacterium
  REGION 1..789: note = MG2-33 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNACPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVLKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRS

SEQ ID NO: 350 - protein, 789 aa, unidentified; identical to SEQ ID NO: 349
  REGION 1..789: note = Description of Unknown:uncultivated organism with predicted taxonomy: Verrucomicrobiabacterium
  REGION 1..789: note = MG2-34 effector

SEQ ID NO: 351 - protein, 783 aa, unidentified
  REGION 1..783: note = Description of Unknown:uncultivated organism with predicted taxonomy: Thermoguttaterrifontis
  REGION 1..783: note = MG2-35 effector
VVIGGSRPLLKEERFALNSIMEATGYFTKATLKKAFEKSLKLDPVNLDAMFLIPEMEQALTLDPARREVTTNKIIKPVWKTVPAIWKNIFSNQLFHGRNYQGKPPSFSQWRDRIKEKGDSIEEFDDSVASAYKVECQNLSKKGLEVSFEEFCGRPIRVSKRHMASGRAPYSRGKLTEAVHCVFNGDDPKAEGGPLEETEAVRCAQWNLEIDENTNNHLVRHRLKVFVRVLEDLVKRYADNDPRNVSSVCVEVVRDLVEFSGKSAKEKARILGQQLWHHRKISKFLEEEKAKNEGNWEISAGLIKKARIADDLNWICPYTGKQYSLNQIIHGDVDLEHIIPRSKRPTDALHALVLTFSHINREKGARTGLQYIEDTKDSPHTLTPEQYRKFVGRLKKNGPSKDDELRCTKRKIALLTQDYEPRGKAKEKSDSESVSGFTEGSLTQTSYLNKLAAQQVQRWFSDQLDEDVKLPPVVQLSGSVTAAVRRSWDLFDQLQQVCPETRGKSKSDIRGMTHLHHALDAVTVGLAAHLFPKDGHLWALMSKRKITRPSDRDYMRSRLGDLVSFNNDGKWRLEALPESLLFEVAGKLAEQRVVRHMPGTMRGLKVQQNVWRILGEDSRDESKMVIRMRPRGEDGKKTIKQKTEKKSKLLGALPKNASSKLKDLKGALIVEENYGVALDPEPVVMPYRQVWKQLVELRKQNGGQPVRVIRNGNVISVKKGRYAGKWRVHSIKDASMGLVLDMAAPDLVKAENQSHRSKMNVLLKTLLKNGLVVMQSDSALFSL

SEQ ID NO: 352 - protein, 1114 aa, unidentified
  REGION 1..1114: note = Description of Unknown:uncultivated organism with predicted taxonomy:Coraliomargarita sp. CAG:312
  REGION 1..1114: note = MG2-36 effector
LASYSTKKNGAIIRAAEQENSFTFEVPYERAVFKFEPLILSLIPFKINDNNLKMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSGGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 353 - protein, 817 aa, unidentified
  REGION 1..817: note = Description of Unknown:uncultivated organism with predicted taxonomy:Coraliomargarita sp. CAG:312
  REGION 1..817: note = MG2-37 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVSVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGE

SEQ ID NO: 354 - protein, 1061 aa, unidentified
  REGION 1..1061: note = Description of Unknown:uncultivated organism with predicted taxonomy:Coraliomargarita sp. CAG:312
  REGION 1..1061: note = MG2-38 effector
MSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDVKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 355 - protein, 1108 aa, unidentified
  REGION 1..1108: note = Description of Unknown:uncultivated organism with predicted taxonomy: Verrucomicrobiabacterium
  REGION 1..1108: note = MG2-39 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPRRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 356 - protein, 1114 aa, unidentified
  REGION 1..1114: note = Description of Unknown:uncultivated organism with predicted taxonomy:Coraliomargarita sp. CAG:312
  REGION 1..1114: note = MG2-40 effector
LASYSTKKNGAIIRAAEQENSFTFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMDDLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 357 - protein, 1108 aa, unidentified
  REGION 1..1108: note = Description of Unknown:uncultivated organism with predicted taxonomy:Coraliomargarita sp. CAG:312
  REGION 1..1108: note = MG2-41 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 358 - protein, 1108 aa, unidentified
  REGION 1..1108: note = Description of Unknown:uncultivated organism with predicted taxonomy:Coraliomargarita sp. CAG:312
  REGION 1..1108: note = MG2-42 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVVPEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 359 - protein, 1108 aa, unidentified; identical to SEQ ID NO: 357
  REGION 1..1108: note = Description of Unknown:uncultivated organism with predicted taxonomy: Verrucomicrobia
  REGION 1..1108: note = MG2-43 effector

SEQ ID NO: 360 - protein, 1114 aa, unidentified
  REGION 1..1114: note = Description of Unknown:uncultivated organism with predicted taxonomy:Coraliomargarita sp. CAG:312
  REGION 1..1114: note = MG2-44 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMDDLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 361 - protein, 1101 aa, unidentified
  REGION 1..1101: note = Description of Unknown:uncultivated organism with predicted taxonomy:Coraliomargarita sp. CAG:312
  REGION 1..1101: note = MG2-45 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWGLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKS

SEQ ID NO: 362 - protein, 1114 aa, unidentified; identical to SEQ ID NO: 356
  REGION 1..1114: note = Description of Unknown:uncultivated organism with predicted taxonomy:Coraliomargarita sp. CAG:312
  REGION 1..1114: note = MG2-46 effector

SEQ ID NO: 363 - protein, 1108 aa, unidentified; identical to SEQ ID NO: 357
  REGION 1..1108: note = Description of Unknown:uncultivated organism with predicted taxonomy: Verrucomicrobiabacterium
  REGION 1..1108: note = MG2-47 effector

SEQ ID NO: 364 - protein, 1114 aa, unidentified
  REGION 1..1114: note = Description of Unknown:uncultivated organism with predicted taxonomy:Coraliomargarita sp. CAG:312
  REGION 1..1114: note = MG2-48 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPEISPNGSILRKARIADDLGWVCPYTGCHFSPRQLFESGNMEREHIIPRSLRPSDSLESLVITWKEVNDMKGQCTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 365 - protein, 1108 aa, unidentified; identical to SEQ ID NO: 357
  REGION 1..1108: note = Description of Unknown:uncultivated organism with predicted taxonomy:Coraliomargarita sp. CAG:312
  REGION 1..1108: note = MG2-49 effector

SEQ ID NO: 366 - protein, 1114 aa, unidentified
  REGION 1..1114: note = Description of Unknown:uncultivated organism with predicted taxonomy:Coraliomargarita sp. CAG:312
  REGION 1..1114: note = MG2-50 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKIGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVCEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 367 - protein, 888 aa, unidentified
  REGION 1..888: note = Description of Unknown:uncultivated organism with predicted taxonomy:Coraliomargarita sp. CAG:312
  REGION 1..888: note = MG2-51 effector
VDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTAYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIAREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 368 - protein, 1108 aa, unidentified
  REGION 1..1108: note = Description of Unknown:uncultivated organism with predicted taxonomy: Verrucomicrobiabacterium
  REGION 1..1108: note = MG2-52 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLVVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 369 - protein, 1108 aa, unidentified
  REGION 1..1108: note = Description of Unknown:uncultivated organism with predicted taxonomy: Verrucomicrobiabacterium
  REGION 1..1108: note = MG2-53 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 370 - protein, 865 aa, unidentified
  REGION 1..865: note = Description of Unknown:uncultivated organism with predicted taxonomy:Coraliomargarita sp. CAG:312
  REGION 1..865: note = MG2-54 effector
MSINILNNLRESNKFELSFDIGYSSIGWSVFKKQSGGIFPTLLGAGTVIFDDDACLAKSRAGFRRMRKNIASRRNRIKRLRDAMLNLDVMAVDELDNAKTAYPWFLSAKVLACGKKLSWSELWSVIRYYAHNRGYDGNSAWAEIESDSDGDFEKEANAKKLMAELGTSTQAETVCAYLGVDVKSDKPLSLRKYFKGQNLAFPRETVVKEVERIIDAHIGVLPKCDGNFKKLMIGNWREVPSNIELPRRFTSDRGLLFGQYIPRFDNRIITKCPISGEKTPNCHSREFLDFRWKSLLANMAFPDGADLIAARAKVDAAMFLYGALKKTVLKKILKEVLGELPSNYNAMFLASEMEKALELDPVKALILKTAYPNISFSLPSAELVEKLWKLIPKFVFTRMFKLKEYSFADICALLDSEKSEELKNVVRAIFDSSASSKKSPKPDFETAFNYKMRVKKISGRSPYSRRLMKLASEEIMRGIDPRSEGGSLYPRRDSTRKELLSNIDSWTNNHLVRHRLKMFKRLYMDIVNEYCGGDISLVKSVAIEVVKDMTAFSGLDSKKKAAKLKDLVAHHESVSKYLKNEYPNLKTNGSILRKARIADDLGWVCPYTGCHFSPRQLFESGNMEKEHIIPRSLRPSDSLESLVVTWKEVNDMKGQRTALEFIKECQGMKVPGRPNLSIVTPARFEEFVSGLRKPMHRAGKADIERIKIRNKLLLTEHYKNREGEFLPSDLTQTSHLNKLAFKLVKSLYVDAGKTPELVHLPGSVTSAVRKNWELLPCMGDVCPEIYETLENGDKVLLLKDKIRSITHLHHAVDAVAMGLAASVFPRTKRFYEAVSKRHLSEADREELLNTGLVLFSDDKWKLVEL

SEQ ID NO: 371 - protein, 1061 aa, unidentified
  REGION 1..1061: note = Description of Unknown:uncultivated organism with predicted taxonomy:Coraliomargarita sp. CAG:312
  REGION 1..1061: note = MG2-55 effector
MSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVDRIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 372 - protein, 1114 aa, unidentified
  REGION 1..1114: note = Description of Unknown:uncultivated organism with predicted taxonomy:Coraliomargarita sp. CAG:312
  REGION 1..1114: note = MG2-56 effector
LASYSTKKNGAIIRAAEQENSFIFEVPYERAVFKFEPLILSLIPFKINDNNLKMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPRRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWNLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 373 - protein, 1108 aa, unidentified
  REGION 1..1108: note = Description of Unknown:uncultivated organism with predicted taxonomy:Coraliomargarita sp. CAG:312
  REGION 1..1108: note = MG2-57 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTSKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 374 - protein, 1108 aa, unidentified; identical to SEQ ID NO: 357
  REGION 1..1108: note = Description of Unknown:uncultivated organism with predicted taxonomy: Verrucomicrobiabacterium
  REGION 1..1108: note = MG2-58 effector

SEQ ID NO: 375 - protein, 1061 aa, unidentified; identical to SEQ ID NO: 354
  REGION 1..1061: note = Description of Unknown:uncultivated organism with predicted taxonomy:Coraliomargarita sp. CAG:312
  REGION 1..1061: note = MG2-59 effector

SEQ ID NO: 376 - protein, 1114 aa, unidentified; identical to SEQ ID NO: 366
  REGION 1..1114: note = Description of Unknown:uncultivated organism with predicted taxonomy:Coraliomargarita sp. CAG:312
  REGION 1..1114: note = MG2-60 effector

SEQ ID NO: 377 - protein, 1114 aa, unidentified
  REGION 1..1114: note = Description of Unknown:uncultivated organism with predicted taxonomy:Coraliomargarita sp. CAG:312
  REGION 1..1114: note = MG2-61 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 378 - protein, 1101 aa, unidentified
  REGION 1..1101: note = Description of Unknown:uncultivated organism with predicted taxonomy: Verrucomicrobia
  REGION 1..1101: note = MG2-62 effector
MDPANLALSFDIGYASLGWAVFLLKDPFPSLLGSGSVLFQKDSCLASSRRAFRRARRNIAARRSRVARLKKYLASLGVLEREQLDENACAYPWLLAARVLASDGKEKLSWQELWHVLRWYAHSRGYDGNALWAGDALDETGADDEDTQKVKAARALMEKYGKTTMAETVCADLQLEPFGEKRASRRYFKGNNAAFPRETVRDEVRRILLAHAGVLPKVDDALAATLLNDVPENLCAALRLPARFSAKGGLLFGQYVPRFDNRIIGHCRITGKNVPLKNCREYLLYRWGRLLNNLTVFARDGSIRTLSADKPNGRPSEREKLDAEMRSRGFFDKKKLNDLLKEITGCEPANTESYFLIPEMEDALILDPVRKLIATKKLVKDFWGYFSERGKKIFAAELAKGKTLKLSDCIKRMDGWGGWKTKPLFAAALEKLKAAEMKKKPEKRRNLLNLRIKAEFPTGRASYCREILKKTYEEALAGKDSTQPGGCLYETPEIRERLLRGNAVGDDAGTVATEQWLAGQTNNHMVRHRMLIFSRLLRDIIREYAEGDAARVKDVVVEVVRELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDLTQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVPAKMHGLAVEQTTWSIVSQDEATRKVSLEQHTTDLKKGRYKDDGTRFVKNCEEKPALLLGFGVPEEQKSKLQAIKGVVKICENWGCALDPEPVVIPYFKVFPRLRELRERNGGKPVRVLRRGQQIEVLSGKFKGVWTIVSIKDATRDGILLDICAPDKVRQTEHGTTDSKVGVLLKSLLRAGLKILKPPLTGFACPTTSSQ

SEQ ID NO: 379 - protein, 1114 aa, unidentified
  REGION 1..1114: note = Description of Unknown:uncultivated organism with predicted taxonomy:Coraliomargarita sp. CAG:312
  REGION 1..1114: note = MG2-63 effector
LASYSTKKNGATIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 380 - protein, 888 aa, unidentified; identical to SEQ ID NO: 367
  REGION 1..888: note = Description of Unknown:uncultivated organism with predicted taxonomy:Coraliomargarita sp. CAG:312
  REGION 1..888: note = MG2-64 effector

SEQ ID NO: 381 - protein, 1108 aa, unidentified; identical to SEQ ID NO: 369
  REGION 1..1108: note = Description of Unknown:uncultivated organism with predicted taxonomy:Coraliomargarita sp. CAG:312
  REGION 1..1108: note = MG2-65 effector

SEQ ID NO: 382 - protein, 1046 aa, unidentified
  REGION 1..1046: note = Description of Unknown:uncultivated organism with predicted taxonomy:Coraliomargarita sp. CAG:312
  REGION 1..1046: note = MG2-66 effector
LPSYSTKKNGAIIRAAEQENSFIFEVPYERAVFKFEPLILSLIPFKINDNNLRMSTTNLNNFNLSFDIGYSSIGWSISSKPANAVFPNWLGAGVVVFDDDSCMAKSRAEFRRMRRNIASKRNRIKRMREVLYGLGVMGKDELDNAKTEHPWFLAAETLASGKILSWSELWSVLRYYAHNRGYDGNSMWAKFGDDSDGDFEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILR

SEQ ID NO: 383 - protein, 1114 aa, unidentified; identical to SEQ ID NO: 352
  REGION 1..1114: note = Description of Unknown:uncultivated organism with predicted taxonomy:Coraliomargarita sp. CAG:312
  REGION 1..1114: note = MG2-67 effector

SEQ ID NO: 384 - protein, 1114 aa, unidentified; identical to SEQ ID NO: 364
  REGION 1..1114: note = Description of Unknown:uncultivated organism with predicted taxonomy:Coraliomargarita sp. CAG:312
  REGION 1..1114: note = MG2-68 effector

SEQ ID NO: 385 - protein, 1114 aa, unidentified; identical to SEQ ID NO: 356
  REGION 1..1114: note = Description of Unknown:uncultivated organism with predicted taxonomy:Coraliomargarita sp. CAG:312
  REGION 1..1114: note = MG2-69 effector

SEQ ID NO: 386 - protein, 1114 aa, unidentified; identical to SEQ ID NO: 360
  REGION 1..1114: note = Description of Unknown:uncultivated organism with predicted taxonomy:Coraliomargarita sp. CAG:312
  REGION 1..1114: note = MG2-70 effector

SEQ ID NO: 387 - protein, 1114 aa, unidentified; identical to SEQ ID NO: 356
  REGION 1..1114: note = Description of Unknown:uncultivated organism with predicted taxonomy:Coraliomargarita sp. CAG:312
  REGION 1..1114: note = MG2-71 effector

SEQ ID NO: 388 - protein, 1114 aa, unidentified
  REGION 1..1114: note = Description of Unknown:uncultivated organism with predicted taxonomy:Coraliomargarita sp. CAG:312
  REGION 1..1114: note = MG2-72 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDMWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 389 - protein, 1108 aa, unidentified; identical to SEQ ID NO: 368
  REGION 1..1108: note = Description of Unknown:uncultivated organism with predicted taxonomy: Verrucomicrobiabacterium
  REGION 1..1108: note = MG2-73 effector

SEQ ID NO: 390 - protein, 1101 aa, unidentified
  REGION 1..1101: note = Description of Unknown:uncultivated organism with predicted taxonomy: Verrucomicrobia
  REGION 1..1101: note = MG2-74 effector
MDPANLALSFDIGYASLGWAVFLLKDPFPSLLGSGSVLFQKDSCLASSRRAFRRARRNIAARRSRVARLKKYLASLGVLEREQLDENACAYPWLLAARVLASDGKEKLSWQELWHVLRWYAHSRGYDGNALWAGDALDETGADDEDTQKVKAARALMEKYGKTTMAETVCADLQLEPFGEKRASRRYLKGNNAAFPRETVRDEVRRILLAHAGVLPKVDDALAATLLNDVPENLCAALRLPARFSAKGGLLFGQYVPRFDNRIIGHCRITGKNVPLKNCREYLLYRWGRLLNNLTVFARDGSIRTLSADKPNGRPSEREKLDAEMRSRGFFDKKKLNDLLKEITGCEPANTESYFLIPEMEDALILDPVRKLIATKKLVKDFWGYFSERGKKIFAAELAKGKTLKLSDCIKRMDGWGGWKTKPLFAAALEKLKAAEMKKKPEKRRNLLNLRIKAEFPTGRASYCREILKKTYEEALAGKDSTQPGGCLYETPEIRERLLRGNAVGDDAGTVATEQWLAGQTNNHMVRHRMLIFSRLLRDIIREYAEGDAARVKDVVVEVVRELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDLTQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVPAKMHGLAVEQTTWSIVSQDEATRKVSLEQHTTDLKKGRYKDDGTRFVKNCEEKPALLLGFGVPEEQKSKLQAIKGVVKICENWGCALDPEPVVIPYFKVFPRLRELRERNGGKPVRVLRRGQQIEVLSGKFKGVWTIVSIKDATRDGILLDICAPDKVRQTEHGTTDSKVGVLLKSLLRAGLKILKPPLTGFACPTTSSQ

SEQ ID NO: 391 - protein, 1089 aa, unidentified
  REGION 1..1089: note = Description of Unknown:uncultivated organism with predicted taxonomy:Coraliomargarita sp. CAG:312
  REGION 1..1089: note = MG2-75 effector
VPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 392 - protein, 876 aa, unidentified
  REGION 1..876: note = Description of Unknown:uncultivated organism with predicted taxonomy: Verrucomicrobiabacterium
  REGION 1..876: note = MG2-76 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWQWKLAGRVLAGGKTLTWTELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFVKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPDR

SEQ ID NO: 393 - protein, 1090 aa, unidentified
  REGION 1..1090: note = Description of Unknown:uncultivated organism
  REGION 1..1090: note = MG2-77 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWPWKLAGRVLAGGKTLTWHELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 394 - protein, 1090 aa, unidentified
  REGION 1..1090: note = Description of Unknown:uncultivated organism with predicted taxonomy: Verrucomicrobiabacterium
  REGION 1..1090: note = MG2-78 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 395 - protein, 1087 aa, unidentified
  REGION 1..1087: note = Description of Unknown:uncultivated organism with predicted taxonomy: Verrucomicrobiabacterium
  REGION 1..1087: note = MG2-79 effector
MNATQKIQPATNSDLQLAFDVGHSSLGWAVLQSSAGIPPAAKRTAGDNSINILSCGAVVFRADDCLASSRRTYRRQRRHIRSTKQRIARMKIILRHLGVLKENELNQPGCAWPWQLAARILQGGKLLTWPELWDVLRWYAHNRGYDGNRRWSAAEAEAQKEDSEKEANARTLMGKHGVHSMAETFCKELGVDPLGKKKSSMKRFKGLNAAFPREVVEGEVRKVLQAHSGKLKGVDVNLEKNLFSDWRAIPCPDLKLPKRYEDGLLFGQLVPRFDNRIISICPISGQKVPSRNCPEFLNFRWAMQLANIKVGKTKDRELQPLKTEYRVALDKQMRERGYLTPKELKDTVRSITSCERDNLDTMLMHPDAKEALLLDPVQKLICSNDLQPLWKLLPERLQKRLRGQWRHNKVFTLAQIRKQLESLGDVSAFDAEFQKQLDTQNSKAKKKEKQVTREQLLQQHFPSRPLKLDGRAAFARHLLKQAYEDVLAGKPHPKEEGGCLFITKKIREAQLNRAIADQTNNHLVRHRLLILERLLADIIKEYAAGDKKRVGKITIEVNRDLREMSGKTAKEKAQDLGLRIANHHAVAEKLEKAFAEERNGKSIPITAGLIRKARIAEDLGWRCPYTGIDYEPKDLVTKRVDKDHIVPRSERASDSLDSLVITLSAINKWKGKRTAWQFVEQEQGKPVPDLPNLSIVSLTRYKQFVESLETYKGHDDDKRRKKKRKELMLLPKYEEREFVPRDLTQTSQLVRLGGQVLKRAFANSEEKPTLVSLPGSVTGAVRKAWKVLGCLSLANQQVLDENGDVKTKTDIRDITHLHHALDACVLGLTSHFIPNNGRVWELIVKRNPNDLERQQLMALGVFGFNAEKRFEMRDLDNKLKEQIRQRLAEKRVVQHIPARMDGLRVEQNTWRVVSSDENGNVTIRQRIRQADGSRPEKLGEEKTTKLLGLKPANGNGKLAANKGVLVIPDNYGVALDPLPTIIPFHKVWPRLQELKKANGGKLPRVLRNGQTIKVPEGKYKGVWRIFSAKNNATGMAIDIGQPDVVRLKNKTEGHKINVLLTSLLKNKMEVVKTPFTGISAIPATSST

SEQ ID NO: 396 - protein, 974 aa, unidentified
  REGION 1..974: note = Description of Unknown:uncultivated organism with predicted taxonomy: Verrucomicrobiabacterium
  REGION 1..974: note = MG2-80 effector
DVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDINEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 397 - protein, 851 aa, unidentified
  REGION 1..851: note = Description of Unknown:uncultivated organism with predicted taxonomy: Verrucomicrobiabacterium
  REGION 1..851: note = MG2-81 effector
MSPKLEFSFDVGHSSIGWAVLQSSAVVSPVANAPRVNILGCGVVTFGADDCLASKRRDYRRQRRHARSTRHRIAQLEKLLAHLKVLSADQLKQKHQQAGGHAAPWFLAARVLASNGAAKYLLDWPQLWDVLRWYAHNRGYDGNRRWSAQEAEAQSEDTEKEKTANALMEKHGTTTMAETLCKALGLEPLGDKQSSKENFKRLNAAFPRSIVEKEVRRLLELHQKKLPAITDTFLKSLFEDWRAAKISDLKLPDRYQGGLLFGQLVPRFDNRIISTCPITGEKVPSKNCPEFLKFRWAMTLANIRVAGAKEKELRPLAADERKKINVVMESEGALTPRELTKLVRETTGCTRDNLDTMLMHPDAKDGLLLNPIQKLVQGDKLKTLWPTFSPRVQKRARDLWERGKPVTLEHICGIAKKLGESLANFEAKLNKLADSANTKRSKKAGSLDSEALLKEPLTIKKSDGRAAYARPLLVRAYAEVMAGKHPKEDGNSLCVTEEMRQAQLQKQIDQQTNNHLVRHRLLILERLLKDLIADSAFANGDKSRIARTTIEVNRDLREMSGKSAKEIQQDLGRRLANHHGVAAKLDADLDGRTFNGKPIQITAGLIRKARIAEDLGWTCPYTGKTYDAIDLVSRQVDKDHIIPRSLRPSDSLDSLVVTFAEVNKMKGQRTAWKFVSDEQGKVVEGSPQLSIVSLTRFKQWAESLETYKGHDDDKRRKKKRKELLLLPNYEEKGFVPRDLTVTSQLVRLGAQIIKKTFAGSEKPPMVVSLPGSVTGTVRKGWNLLGCLELAAPQVKEADGGIKNKTDIRDVTHLHHALDACVLGLASYYLPNNGGLWEVMIKRNPNDGEKAL

SEQ ID NO: 398 - protein, 1082 aa, unidentified
  REGION 1..1082: note = Description of Unknown:uncultivated organism with predicted taxonomy: Verrucomicrobiabacterium
  REGION 1..1082: note = MG2-82 effector
PDLSLSFDVGLSSIGWAVLQTSPDVEIKGCGVVIFRADDCLASARRGYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLKDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 399 - protein, 1075 aa, unidentified
  REGION 1..1075: note = Description of Unknown:uncultivated organism
  REGION 1..1075: note = MG2-83 effector
MSIKGKISNGADANLQISFDVGHSSIGWAVLEKTGQQVSDIKINGCGSVVFRADDCLASSRRAYRRQRRHIRSTRQRIARMKILLKHLGVLTEKELDKPGCAWPWKLAAQILQGGKLLTWPELWDVLRWYAHNRGYDGNRRWSAAENDAQSEDSEKEENARSLMGKYGTKSMAETFCAISGINPLGEKKSANLSGDKRPKGQNAAFPREIVELEVRQILQKHFGKLKNADENLEKVLFTDWQTISCPDLKLPKRYEGGLLFGQLVPRFDNRIISTCPISGQKVPTRNCTEFLNFRWAMQLANIRIACAGEKELRPLTAAERKIIDQAVSEKGGVTPFQLKLIVREKTKCVRDDLEQMLMLPDFEKALLLNPIQKMISADDFQPYWKLLPDRLQKRLRGKWRRGKVFSLAQIRTQLESLGDASAFDAELQRQLDAHNSNAKKKDKQITRENLLQKHFPSKPLKLDGRAAFARHLLKQAYDEVLAGKDPNGKGGCLFRSEEIRQKELNREISDQTNNHLVRHRLLILERVLNDIIKEYAGGKKDRIGKITIEVNRDLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDLTQTSQLVRLGAQVLKKNLPHLTTGDVTSLPGSVTGTVRKGWKLEACLGLANPQVFDGNGGAKTKTEIRDITHLHHALDACVLGIAANYFQNQKLGASSLWELLIKRKYNEQEKTILRALGIFQFDKEGNSQIKELPKEIREQIRQRLAEKRVVQHIPARMDGLRVEQNTWRVVAVKDGEVILKQRIRQPDGTRPEKIAEEKPGKLLGLNPTNGNGKLAANKGALVIPDNFGVALDPQPIVIPFHKVWTRLQELKKANAGKLPRVLRNGQLIRVKDGTYKGVWRVFSAKNNATGMALDIGSPDVVRLKNKTEGHKINVLLSSLIKGGLEPIQSSFTGITSK

SEQ ID NO: 400 - protein, 938 aa, unidentified
  REGION 1..938: note = Description of Unknown:uncultivated organism with predicted taxonomy: Verrucomicrobiabacterium
  REGION 1..938: note = MG2-84 effector
VYHNGDMASRRNAPDLQLAFDVGHSSIGWAVLQANPDVEIAGCGVVIFRADDCLASARRGYRRQRRHIRSTRQRIKRMKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRL

SEQ ID NO: 401 - protein, 1090 aa, unidentified
  REGION 1..1090: note = Description of Unknown:uncultivated organism with predicted taxonomy: Verrucomicrobiabacterium
  REGION 1..1090: note = MG2-85 effector
MSAKQNPPPDLSLSFDVGHSSIGWAVLQTSPDVEIKGCGVVIFRADDCLASARRVYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 402 - protein, 985 aa, unidentified; identical to SEQ ID NO: 326
  REGION 1..985: note = Description of Unknown:uncultivated organism
  REGION 1..985: note = MG2-86 effector

SEQ ID NO: 403 - protein, 909 aa, unidentified
  REGION 1..909: note = Description of Unknown:uncultivated organism with predicted taxonomy: Methylococcalesbacterium
  REGION 1..909: note = MG2-87 effector
LENAKTLMDKPGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 404 - protein, 985 aa, unidentified; identical to SEQ ID NO: 326
  REGION 1..985: note = Description of Unknown:uncultivated organism
  REGION 1..985: note = MG2-88 effector

SEQ ID NO: 405 - protein, 985 aa, unidentified; identical to SEQ ID NO: 326
  REGION 1..985: note = Description of Unknown:uncultivated organism with predicted taxonomy: Verrucomicrobia
  REGION 1..985: note = MG2-89 effector

SEQ ID NO: 406 - protein, 807 aa, unidentified
  REGION 1..807: note = Description of Unknown:uncultivated organism with predicted taxonomy: Verrucomicrobiabacterium
  REGION 1..807: note = MG2-90 effector
MSIKGKISNGADANLQISFDVGHSSIGWAVLEKTGQQVSDIKINGCGSVVFRADDCLASSRRAYRRQRRHIRSTRQRIARMKILLKHLGVLTEKELDKPGCAWPWKLAAQILQGGKLLTWPELWDVLRWYAHNRGYDGNRRWSAAENDAQSEDSEKEENARSLMGKYGTKSMAETFCAISGINPLGEKKSANLSGDKRPKGQNAAFPREIVELEVRQILQKHFGKLKNADENLEKVLFTDWQTISCPDLKLPKRYEGGLLFGQLVPRFDNRIISTCPISGQKVPTRNCTEFLNFRWAMQLANIRIACAGEKELRPLTAAERKIIDQAVSEKGGVTPFQLKLIVREKTKCVRDDLEQMLMLPDFEKALLLNPIQKMISADDFQPYWKLLPDRLQKRLRGKWRRGKVFSLAQIRTQLESLGDASAFDAELQRQLDAHNSNAKKKDKQITRENLLQKHFPSKPLKLDGRAAFARHLLKQAYDEVLAGKDPNGKGGCLFRSEEIRQKELNREISDQTNNHLVRHRLLILERVLNDIIKEYAGGKKDRIGKITIEVNRDLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDLTQTSQLVRLGAQVLKKNLPHLTTGDVTSLPGSVTGTVRKGWKLEACLGLANPQVFDGNGGAKTKTEIRDITH

SEQ ID NO: 407 - protein, 1075 aa, unidentified; identical to SEQ ID NO: 399
  REGION 1..1075: note = Description of Unknown:uncultivated organism
  REGION 1..1075: note = MG2-91 effector

SEQ ID NO: 408 - protein, 774 aa, unidentified
  REGION 1..774: note = Description of Unknown:uncultivated organism with predicted taxonomy:Verrucomicrobiae bacterium Tous-C5FEB
  REGION 1..774: note = MG2-92 effector
ELWDVLRWYAHNRGYDGNQRWSNREMIRAFNSEGLHQTSKPSADDEKSLVAAAEKADAEAGVQNEADSDVKKVKEAFKQMHDYGTSTMAETMASHIAKFEIQAAEHRLGKRQEKPTRFKGLGAAFPRRIIRVINNEQTLAGGVEWEVRYILRAHFGHLPNCDANFERAICGGLPESKFDWRAYEQSHPTLYLTSKAEKLKLRELRIPRKADKQTKADKKKLRTEFLRNKLVLSSHFEGGVLFGQAVPRFDNRIISICPITGEKVPSKNCREFLKFRWAMMLANIHVAGAKEKELHPLTGDERKKINAVMENEGALTPTTLKRSVRETTNCTRDNLEMMLMHPDAKDALLLNPIQKLVRSEKLKTIWPTFSYPVQKRARDLWLRGKLVTLERICGIAQKLGESLTGFEAELNKLADVANTKRGKKESSFNREALMREPLTIIKLDGRAAYARPLLVRANAEVMAGKHPKEEGGCLEVTDAMRQVQLQKQIDQQTNNHLVRHRLLILERLVKDLVAEPAFASGDKSRIAKCTIEVNRDLREMSGKSSKEIQQDLGRRLANHHGVAAKLEKDLDGRTFNGKPIQITAGLIRKARIAEDLSWMCPYTSKAFDAIDLVSRQVDKDHIIPRSLRPSDSLDSLVVTFAEVNKMKGQRTALQFVSDEQGKTVEGSPQLSIVSLTRFKQWAESLETYKGHDDDKRRKKKRKELLLLQTYEEKGFVPRDLTVTSQLVRLGAQIIKKTFAENEKLPTVVSLPGSVTGTVRKGWNLLGCLATAAPQ

SEQ ID NO: 409 - protein, 1081 aa, unidentified
  REGION 1..1081: note = Description of Unknown:uncultivated organism
  REGION 1..1081: note = MG2-94 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIPAKMHGIVVDQTTWGIVASGAITKLCQKTTEKNARYDENGRRFVKTAEEKRSLLLGGPNAPEGKLARIKGAILITENWGCALDPAPPTVIPHFKVYPQLRALREKNGGRPVRILRKGSLIQIKTGRFQGIWSVASIKDNADGICLDINAADKIKIENGSVDSKINVRLNSLLNSGLKILKPKLTGTCPTTSSP

SEQ ID NO: 410 - protein, 1081 aa, unidentified; identical to SEQ ID NO: 409
  REGION 1..1081: note = Description of Unknown:uncultivated organism
  REGION 1..1081: note = MG2-95 effector

SEQ ID NO: 411 - protein, 1080 aa, unidentified
  REGION 1..1080: note = Description of Unknown:uncultivated organism
  REGION 1..1080: note = MG2-96 effector
MKQGQIAFSFDIGHSSIGWAAFQVSDAPGTFHSLLGTGVVLFPKDACLASARRGFRRSRRNIAARRSRIDRLKNYLAGLGVLSRDQLDANSNSYPWLLAARILASDGKKTLTWEELWSVLRWYAHNRGYDGNALWAGDDADAGDKEDTDKVKNSIALMEKHKTATMAETVCKALGLDPMGEVKASRIYFKGNNAAFPRGVVTEEVRRILAAHAGKLPKVDDALSDILLRNAATSGLELPARFKGGLLFGQYVPRFDNRIIPACRITGKNTPLKRCPEYLLYRWGRLLNNLTVFGADGQIRTLLPAERQALHSRMEADGFFTKRTLNAALKDVTGCTPANTESFFLTEEMEEALVLDPVKKLLATNQIMKDLWPQLSAESREKAQSSLSAGKKIRLGDILAEMETAGQDTTAASDALASHQKKAKKKNADLATRRLSADYPKGRAAYCREILAKTFDESISGKDSTKEGGCLYETEEIRNRLLREPLVQQTNNHLVRHRLLVFERLLAHMVEEFAGGDEKRIAATVVEVVRELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDLTQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIPAKMHGIIVDQTTWGIVAAGAITTLRQKTTEKNARCDENGKRFIKTTEKKRSLLLGGPDAPDGKLAKIKGAILVTENWGCALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 412 - protein, 953 aa, unidentified
  REGION 1..953: note = Description of Unknown:uncultivated organism with predicted taxonomy: Acidobacteriabacterium RIFCSPLOWO2_12_FULL_68_19
  REGION 1..953: note = MG2-97 effector
MKQDQIAFSFDVGHSSIGWAVFKIADTPESFHTLLGTGVVLFPKDSCLASSRRGFRRSRRNIAARRSRIDRLNNFLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGADGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAQLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAFEAYVAKHTKQYRYGTDDRRRCERRAELMLMERYDQRNADFTERDLTQTSHLNKMAISLVKQRIGIDAKHLPGSVTAFIRQKLHIDECLFTAVPRLQKTAKGEGKRPKRKNADEVTAEPMQSDMPPRKLTKADIRELTHLHHAMDAVTQGLALLLFAPEDWPLLVKRNLTDSERRLLKSRYPYLVFTENSRMEIQDLPEATLKTISDRLAECRVIRHIPAKMHGIVVDQTTWGIVAAGTITKLRQKTTEKNARCDENGHRFVKTIEEKRSLLLGGPNAPDGKLA

SEQ ID NO: 413 - protein, 1101 aa, unidentified
  REGION 1..1101: note = Description of Unknown:uncultivated organism with predicted taxonomy: Verrucomicrobiabacterium
  REGION 1..1101: note = MG2-98 effector
MTRREKSATAKFITFSFDVGHSSIGWAVLGSGQKRPSIQDAQILGCGVVTFPVDDCLANQRRDFRRQRRHIRSTRLRIERMKRLLLHLGVMTREQLDKPGCAWPWLLAAQAFHGLRTLTWPELWDVLRWFAHNRGYDGNRAWSRFEEEEPEDTERVGQGRALLIEHKTQSMAEVFCHVLGINSRDPAAQKSSRKRIREVLQAAFPRETVKAEVSAILKNHEGKLPKCDDKLATALLTDRKAIDCPTVKFPLRYIWGYLFGQLAPRFENRILTRCPFTDEKVPAKDCPEFYRFRWAMQLANVVVDEDGNSRPLTQTERQAVNARMAECGALTKSEFKKAVADATGGRPNNLETMLMHPDAEKSLVLMPARKTALSGKNKDVFNLLPSALQARLLGKLIRRGSVRLRDIRSWTENDPALLAKFDAVISSWKTKAAGREKTKLDEDETQDPLDRTWKAHPESGRAPFARPILQQAYDDVMAGKDPRMEGGILYRSEEVLRRERDRTLAEQTNNHLIRHRLLILQRLAKDLLKDYAGGKASRIVKAIIEVNSDLRTMSGMTAKERETEMKKRLSNFTSAKIALEKALTGKKIGGKPIPITAGLIRKARLAMDLDMTCPYTGQIYDFIDIAKGRMQRDHVIPYAERASDSLAAQVLTFAEVNKWKDKRTAAQFVREEQGKAVKGKPNLVVLPFEKYKAFVEGLDKGKHPHPDDKARKEKRKKLLLLEEYAEKEFLPADLTITSQLVRLGARTLEKAFTDGNHAPKIVSMPGSVTGRVQRAWSLMGCIAKANPSVLDENGKPKPKGDIRDISHLHHAVDACVLGIAGTLFPNDGSLWKAMAARSPARAEAEQLLATGLYERDSEKHLRLRDLPAALKNQIADRLSERRVYQHVSADMAGLKADQAVWRVVDFKDNHPSAQKLVRAIRIAKLDKDMAEDMAFLAHWKRKGKGVERPKNLLKETESYFVEYDIVPKAKLMGLQPGKLQELKAVKVISENYGLALDPKPEIIPFAQVWRRLAELRAENDGKPVRVLRKGSLFRVGQGKFAGEFKVFSIKKNHNGLSLDIGPRDIPRPLNKMTAQGHYINVLLSSLLKGGLEIMDTDYAMN

SEQ ID NO: 414 - protein, 1080 aa, unidentified; identical to SEQ ID NO: 411
  REGION 1..1080: note = Description of Unknown:uncultivated organism
  REGION 1..1080: note = MG2-99 effector

SEQ ID NO: 415 - protein, 1038 aa, unidentified
  REGION 1..1038: note = Description of Unknown:uncultivated organism with predicted taxonomy: Proteobacteria
  REGION 1..1038: note = MG2-100 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFICDCEKHGRDVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIPAKMHGIVVDQTTWGIVASGAITKLCQKTTEKNARYDENGRRFVKTAEEKRSLLLGGPNAPEGKLARIKGAILITENWGCALDPAPPTVIPHFKVYPQLRALREKNGGRPVRILRKGSLIQIKTGRFQGIWSVAYIKDNADGICLDIN

SEQ ID NO: 416 - protein, 916 aa, unidentified
  REGION 1..916: note = Description of Unknown:uncultivated organism with predicted taxonomy: Bradyrhizobium
  REGION 1..916: note = MG2-101 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMMAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSEKRLLKARYPFLLFNGDNNISIQDLPEAALQTISDRLAECRVVRHIPAKMHGIDLKQTTWGVVTSGAIKKLRQK

SEQ ID NO: 417 - protein, 1088 aa, unidentified
  REGION 1..1088: note = Description of Unknown:uncultivated organism with predicted taxonomy: Methylococcalesbacterium
  REGION 1..1088: note = MG2-102 effector
MNEKQKISPVTVPDLQLAFDVGHSSIGWAVLQNNTGISPATAKPGNDNRSINILGCGSVVFRADDCLASSRRAYRRQRRHIRSTKQRIARMKIILNYLGALTENELNQPGCAWPWQLAARVLQGGKLLTWPELWDVLRWYAHNRGYDGNRRWSAAEAEAQKEDSEKEANARTLMGKYGVHSMAETFCRELGVEPLGKKKSSMKRFKGLNAAFPREVVEGEVRNILQAHSGKLKGVDVNLEKVLFSGWRAIPCPDLKLPKRYEGGLLFGQLVPRFDNRIISICPISGQKVPSRNCPEFLNFRWAMQLANIKVGKVKDRELQPLKVEHRSALDKQMRERGYLTPKELKDAVRSIAGCERDNLDTMLMHPDAKDALLLDPVQKLICSDDLQPFWKLLPERLQKRLRGQWRRGKVFSLTQIRKQLELLDDAGAFDSKLQKQLDTQNTKAKKKDRQVTREELLQKHFPSRPLKLDGRAAFARHLLKQACEDVLAGRPHPKEEGGCLFISEEIRQKQLNREIAEQTNNHLVRHRLLILERLFGDIIKEYAAGKKGRIGKITIEVNRDLREMSGKTAKEKAQDLGLRIANHHAVAEKLEKAFAEERNGKSIRITAGLIRKARIADDLGWKCPYTGQPYEPKHLITRFVDKDHIVPRSDRASDSLDSLVITFSAINKWKGKRTAWQFVSEEQGKPVPDLPNFSILSLARYKQFVETLETYKGHDDDKRRKKKRKELMLLPKYEEKEFVPGDLTQTSQLVRLGAQVLKRVFANSEKKSPVVSLPGSVTGAVRKAWKVLGCLSLANQQVLDENGDVKTKTDIRDITHLHHALDACVLGLTSHFIPNNGRVWELIVKRNPNELEKRELMALGVFGFNAEKRFEMRDLDNKLKEQIRQRLAEKRVVQHIPARMDGLRVEQNTWRVVSSDENGNVTIRQRIRQPDGSRPEKVGEEKATKLLGLKPVNSNGKLAANKGVLIIPDNYGVVLDPVPTIIPFHKVWPRLQELKKANGGKMPRVLRNGQTIKVPEGKYKGVWRVFSAKNNSTGMAVDIGQPDVVRLKNKTEGHKINVLLASLLKNKMQVVKTPFTGIASCPTTSPA

SEQ ID NO: 418 - protein, 961 aa, unidentified
  REGION 1..961: note = Description of Unknown:uncultivated organism with predicted taxonomy: Verrucomicrobiabacterium
  REGION 1..961: note = MG2-103 effector
YDGNQRWSKNASSESESHTLDDASLDKILSDASATEADKDDAKKVKEAKNLMQKNGTHSMAETFCKELGLHPMGKAKASMKRFKGLNAAFPREIVEGEVRRILKAHFGKLPKVDAHFERVLLGKDNQDKLAWQAIPCPELKLPKRYQGGLLFGQLVPRFDNRIISTCPISGEKVPSRNCPEFLNFRWAMQLANVQVARFGEQKLSPLKPDERADLDKQMRAAGGMTAKQFTEAVRSTTSAIRDNLDTMLMHPDAKEALLLDPVQKVVCSDDLAPFWKLLPERLQKRLRGKWRHGKVFTLAQIRTQLELLGDATAFEVELQNQLDTRNTKTKKKDKQVSREELLQKHFPSKPLKLDGRAAFARHLLKKAYEEVLTGKHPKEEGNCLFLTEEIRKKQQEREIADQTNNHLVRHRLLILERLVGDIVKEYAGGDKEQISKATIEVNRDLREMSGKTAKEKAQDLGLRIANHHAVSDKLEKAFAEEGKRTPITAGLIRKARIADDLGWKCPYTGQDYEPKQLVSRYVDKDHIVPRSQRASDSLDSLVITFGAINKWKGNRTAWQFVEQEQSKPVPDLPNLSILTLTRYKQFVESLETYKGHDDDKRRKKRRKDLLLLPKYEEKTFVPRDLTQTSQLVRLGAQVLRNVLPHLKQNDVISLPGSVTGTVRKAWKVLGCLSLANPQVLDENGDVKTKTDIRDITHLHHALDACVLGLVSHFIPNSGQVWELIVKRNPNDTEKKQLTALGVFGFGKDNRFEMRDLDDRLKEQIRQRLAEKRVVQHVPARMDGLRVEQNTWRVVSIKDGEATIQQRIRQADGSRPLKQTEEKVGKLLGLEPGKLSANKGALVIPDNFGVALDPQPTIIPFHKVWTRLQELKKANSGKMPRVLRNGQIIQVPTGRYKGIWRVFSAKATLTLDLGSPDKVRLESKGDGQKREVQIKTLLQDGMVFQKIPLTGIAACPTTSSS

SEQ ID NO: 419 - protein, 1011 aa, unidentified
  REGION 1..1011: note = Description of Unknown:uncultivated organism with predicted taxonomy: Verrucomicrobiabacterium
  REGION 1..1011: note = MG2-104 effector
DAVPDTEKVKNAGELAHDLGTETMAETIAAYTVRYEAAMQAWHRARTAAVTEGKEFKEPKPMVHFKGRNCAFPRESVVWPEVQRLLTALKGKLLNLDDALIRALLGNDVDPLKDREAWKTLPCPALKLPKRYHGGLLFGQMIPRFENRIIGVCPIQFARLEARYLSEGLDAAEAKHRAAKEAKLPAKATPEFLRFRWAMQLANVFGAAPGESKTRPLSAEERRKLTEQAEQRGAFGKVEFKKAVRAVTGWLDKPARDNLDSLLLHPDAERALELDPVQNEIRKSSLRPALDALPDRYRKRLHGKLASGKTVTLAEVRGWLEAGSRRREEAESLAAFDAVLDQEVEKANTKRGKKQEATTRESLLAEKLTAAFPTGRAPYARPILRQAYEEAMSGIDPRAEKSADQPRGVLCQTDELKEAQLHRRLDEQTNNHLIRHRLLILERLLEDLIAAPEFADGDKARVAGLTIEVNRELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDLTVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVPADMGGVLVEENTRGIQGISEDGRRVALRQRAPRDPKTGVRPSAKTTDEAAGKLLGLQPEGGSGKLKRQNGVRVITDNFGVAILDHAPEGEEKFVVIPWHRVWHRLEELKERNGGNRPMLIRNGQLIRVAKGNYAGVWRVFSAKNNTSGMALDIGWPDVVRLQNKTEGHKINVLLASLVKAGLEALPNSLLGLDSRAVCQTAT

SEQ ID NO: 420 - protein, 762 aa, unidentified
  REGION 1..762: note = Description of Unknown:uncultivated organism with predicted taxonomy: Verrucomicrobiabacterium
  REGION 1..762: note = MG2-105 effector
HGGLLFGQMIPRFENRIIGVCPIQFARLEARYLSEGLDAAEAKHRAAKEAKLPAKATPEFLRFRWAMQLANVFGAAPGESKTRPLSAEERRKLTEQAEQRGAFGKVEFKKAVRAVTGWLDKPARDNLDSLLLHPDAERALELDPVQNEIRKSSLRPALDALPDRYRKRLHGKLASGKTVTLAEVRGWLEAGSRRREEAESLAAFDAVLDQEVEKANTKRGKKQEATTRESLLAEKLTAAFPTGRAPYARPILRQAYEEAMSGIDPRAEKSADQPRGVLCQTDELKEAQLHRRLDEQTNNHLIRHRLLILERLLEDLIAAPEFADGDKARVAGLTIEVNRELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDLTVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVPADMGGVLVEENTRGIQGISEDGRRVALRQRAPRDPKTGVRPSAKTTDEAAGKLLGLQPEGGSGKLKRQNGVRVITDNFGVAILDH

SEQ ID NO: 421 - protein, 1134 aa, unidentified
  REGION 1..1134: note = Description of Unknown:uncultivated organism with predicted taxonomy: Rothia
  REGION 1..1134: note = MG3-6 effector
MSTDMKNYRIGVDVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 422 - protein, 1131 aa, unidentified
  REGION 1..1131: note = Description of Unknown:uncultivated organism with predicted taxonomy: Rothia
  REGION 1..1131: note = MG3-7 effector
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGASDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 423 - protein, 1132 aa, unidentified
  REGION 1..1132: note = Description of Unknown:uncultivated organism with predicted taxonomy: Rothia
  REGION 1..1132: note = MG3-8 effector
MSTDMKNYRIGVDVGDRSVGLAAIEFDDAGFPIQKLALVTFRHDGGLDPTDNPKSRKETRGEARRRMRMTRRRKQRLRDLDKVLENLGYTVPEGPEPETYEAWTSRALLASIKLASADELNEHLVRAVRHIARHRGWVNPWWSLDQLERASQEPSETFEIILARARELFGERVPANPTLGMLGALAANNEVLLRPRAEKKKKTGYVRGTPLLAAQVRQIDQVAELRRICEVQGIEEQYETLRNAIFAHKVAYVPTERVGKDPLAPSKNRTIRASLEFQEFRILDSVANLRVRTDSRAKRELTEGEYDAAVEFLMGYTAKEQPSWADVAEEIGVPGNRLIAPVLEDVQQKTAPFDRSSAAFEKAMSKRTEARQWWEANDDDQLRSLFIMFLADATNDTEEAAAVAGLPELYMSWPAEEREALSNIDFEKGRVAYSHETLSKLSEYMHEHRVGLHEARKAVFGVDDTWRPPLAKLEEPTGQPTVDRVLTILRRFVLDCERQWGRPRAITVEHARIGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSLASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 424 - protein, 1050 aa, unidentified
  REGION 1..1050: note = Description of Unknown:uncultivated organism with predicted taxonomy: Dermabacterhominis
  REGION 1..1050: note = MG3-1 effector
MRKRKRQRLKALDRYLAEHGYPDVQPQITPYDAWHARARLVSTKVDDPAQLKNDLALALRHIARHRGWRNPWKTLASTRKLPVPSETLLANQARAREHFGDEVNDSTTVGQIGALAASRDYLLRPRNITVTKGVNQKKNVNDLERSSEEALAAGHPTAPILGWQVRQEDQINEVERIWERQGLPSEELPQILTLLFAQTKPHVPSERVGRDALQPKLYRAPIAALEFQDFRILAAIANLRVRTEGGRRLTKDERFTAFQFMSGWREKEPLSWADVAEELGFSAHALAAPTTETNQRLAFAPTNRTLTTLGTFFKGKKIDAGAREWWQSASYAERSLLAQLIADATPDTQEQADASGLSDVLLQWDEDTVADLMELDLQSGRAAYSTDTLLRLNARMENDGTDLFESIQAEFNIDPSRLPRPDWDDQTGQPTVDRVLTIVRRFVGGCERKYGKPESVTVEHVRTGLMGAEQRSSIIAENNRNRRDSDRIRAELQADGLSEPSRLDVRRHRQVQRQNCTCLYCGTPITTTTSELDHIVPRRGGGSSQGSNLVAVCRECNASKAHRIFAEWAEDSQREGVSVKEAAKRVRHWLNASASMKREVTRRLQQKRTDPPIDERDLASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRKSRGAVHDATVMKALERDLWGEWDAQAIDRLVDPELHLALRKLFTSTKSKKIDVDATSQGLPERYLANQTVQLFDADAPSVMSPRGILRIGAGTHHARLLTWDDPKKGPQLGIQRVFAAEFGEILKDASSNDLFEAPIPFHTMSHRDLQPKVRAAVEQGLTRQIGWITQGDELEIDPADFVGEANAFGNFLREFPERSWSIAGLKKSNTIVIRPLLLSQEGVTAAISPHAAKIVENGIELSNSTLFTAPGTGIIRRTGLGRPRWDSGPAHLPESFNVHARMTQQSARD

SEQ ID NO: 425 - protein, 1134 aa, unidentified
  REGION 1..1134: note = Description of Unknown:uncultivated organism with predicted taxonomy: Micrococcales
  REGION 1..1134: note = MG3-5 effector
MCINGDSMAAVSGFSPCKFGIGIDVGDRSVGFATIEFDDDGFPLSVLASVSYKHDGGLDPTKNKNPISRKATAGVAHRVRRMRKRRRRRLEMLDVKLRSLGFPVPNGEEPQTYQAWQSRAKLIDGRVDEVRELNDHLVRAVRHIARHRGWRNPWWRFPQLLEASENPSDALVAMRREAAQRWPGQALESATIGQLGWLGAHPDVLVRPRSARSEVPVLSSRVMQQDQCAEIRRYWQLQDLPQEALHPILKAVFHQEPPTVPAERIGRDALPGQDAPRAIRAALEFQEYRIRDAVANLRVRTGGANRKRKLTPEENHAVVKYLMEFRQNPSPSWAEVAEHIDIAPTSLIAPIIDDMRIAAAPTDRSTITAEAVLSNMKKDSGARLWWESADQKMRSLLIRFLADTSDYTQPEAEMAGLVDIVSTWPDSEIEKLSSASWQSGRAAYSLQSLERMNAYMAEYSTGAHEARKGVFGVDDSWKPEADPWDAQTGQPVVDRVMTIVRRFVGACERKWGEPERIVIEHVRTGLMGPAQRAEVLREMASGRRKNDRIRQELRTSGIDEPNLSDVKRHRKIQMQGGVCLYCGTDITSATAELDHIVPRAGGGNSTSTNLVAVCRVCNAAKGRRTFPEFASSDTRDAVSLEAAVERVKLWIDDKGIKNIGESRYARDVIRRLKQSTQDEPIDERSLSATAFAAVEIRRKLENHFKDRTKPVRVDVYRGALTRESRRAGRIDAKIRLRGNIDKDRLDIRHHAIDAAVLTLLDPSVAKTLAMRLDLKREQQDSGRDTRWKEFKGLTPASQERFIKWCQASECLADMLRQQIEADRVPVVVPLRISPSNGAVHDDSVRPLTRQKIDSTWDRKSINRIVDPEIHVAMRRLLNNGTSLPEDKNRVLDLPDGNELGPHDEVELFSTSAASIKLRRGGSAEIGGSIHHARVYAWMGAKGQLEYGMMRVFGAEFPTLTKLSGSKDILRMPIHAGSMSYRDMQDRVRKPIESDIAVELGWITQGDELEILPEAHLETAGGLGDFLKSFPETQWTIDGFNDPSRLRVRPRLMSLEGRDTIDAMGHLSDTEKLKIKQALSKGLMVSASELLSHGAKIIRRDHLGRPRWRGNARPVSIELEQVANQLVNHRSVDGQ

SEQ ID NO: 426 - protein, 1132 aa, unidentified
  REGION 1..1132: note = Description of Unknown:uncultivated organism with predicted taxonomy: Rothia
  REGION 1..1132: note = MG3-6 effector
MSADSLNYRIGVDVGDRSVGLAAIELDDDGFPLKKLAMVTFRHDGGKDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRPQNGSVHKDTVEAVLERTVGDSWTDKQVSRIVDPNTYIAFLSLLGRKKELDADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 427 - protein, 1134 aa, unidentified
  REGION 1..1134: note = Description of Unknown:uncultivated organism with predicted taxonomy: Rothia
  REGION 1..1134: note = MG3-7 effector
MSTDPKNYRIGVDVGDRSVGLAAIEFDDAGFPIQKLALVTFRHDGGLDPTKNKTPVSRKKTRGDARRTMRMNRRRKQRLRDLDMMLTNLGYTVPEGPEPETYEAWTSRALLASIKLANVDELNEHLVRAVRHMARHRGWANPWWSIDRLENASREPSETFEIILARARELFGEKVPADPTLGMLGALAANNEVLLRPRDGKKKKTGYVRGTPLLVAKVRQEDQLAELRRICEIQGIEGQYDALRSAIFTHKMAYVPTERVGKDPLNPSKNRTIRASLEFQEFRILDSVANLRVRTDSRSKRELTEAEYDVAVEFLMSYTANEQPSWADVAEVIGVPGNRLIAPVLEDVQQKTAPFDRSSAAFEKAMGKKTEARQWWESTDDDQLRSLFISFLVDATDDTEEAAAEAGLPELYMSWPAEEREVLSDIDFEKGRVAYSQETLSKLSEYMHEYRVGLHEARKAVFGVDDTWRPPLDKLDEQTGQPTVDRVLTILRRFVLDCERQWGRPRAITVEHARTGLVGPAQRQEILNEQKKNRENNELIRGDLRKSGVENPSRAEVRRHLIVQEQESQCLYCGAVIRTDTSELDHIVPRAGGGSSRRENMAAVCHYCNSKKKRTLFYDWAGPVKLQETVDRVRQLEAFKDSKKAKMFKNQIRRLKQTEADVPIDERSLASTSYAAVAVRERLEQHFNEGLAPDDKSRVVLDVYAGAVTRESRRAGGIDERILLRGERDKNRFDVRHHAIDAAVMTLLNRSVALTLEQRSQLRRAFYELELDKLDRDQLKPGEDWRNFTGLYEASQNKFSEWKKAATVLGDLLAEAIEDDAIAVVSPLRLRPQNGSVHDDTINAVKKLTLGSAWPADAVKRIVDPEIYLAMKDVLGKLKELPEDSARSLELSDGRYIEADDEVLFFPKKAASILTPRGAAEIGNSIHHARLYSWLTKKGELKFGMLRVYGAEFPWLMRESGSRDVLHMPIHPGSQSFRGMQDGVRKAVESGEAVEFGWITQDDELEFDPEDYIAHGGDDELNRLLRVMPERRWRVDGFYNAGTLRIRPALLSAEQLPSELQKKVADKTLSDVELILLRAVQRGLFVAISSFLPLESLKVIRRNNLGFPRWRGNGNLPTSFEVRSSALRALGVEG

SEQ ID NO: 428 - protein, 1132 aa, unidentified; identical to SEQ ID NO: 423
  REGION 1..1132: note = Description of Unknown:uncultivated organism with predicted taxonomy: Rothia
  REGION 1..1132: note = MG3-8 effector

SEQ ID NO: 429 - protein, 1110 aa, unidentified
  REGION 1..1110: note = Description of Unknown:uncultivated organism with predicted taxonomy: Brevibacterium
  REGION 1..1110: note = MG3-42 effector
MNKDYAVGFDVGDRSVGVAFVEFDGDVPVKLLRAVAYRHDGGIDPTTNKTPQSRKATAGVARRVRRMRKERRRRLNELDKFLRQAGYPVEGDDRGETYEPWKARANCVTGFIEDEAQRKLELSRAIRHMARHRGWRNPWHTVSQELREHVPSSQHQKNVANAQEIFPGELDANATVGQLGAVAGKYNRLLRPRTNEKAKESGLIPVLSYKVLQCDQLDELQRMCKMQRLDEDFESELLELVFGQKRPVVRAENIGRDELPGMNGHPRAPRSSLEFQEFRIRDSIANLRVKSSRRDRKGVGLASEVVNNVVDYLLEWREPDDPTWAEVAELIGVDPDLLVAPVFDDVRRMIAPVDRTSRLLEKTLSKKAFKPVLEWWNNTSFEQKSMLVALISDPTDHHEDWAVSAGIADVIASWPDGLLEELNSLNFESGRSAYSLLSLKKMNDCMAIRGCNLHDARKEVFDVDDSWRPTPPKIHEPVGHPTVDRVLPIVRRTIMEAHRRWGVPRSIHIEHTRSSLLGPAARAEYQREVNANRRARERSLESLREQGVADPTVATVRRFSAVQHQNGVCLYCGSAITAKPGDSGCELDHVVPRSGGGSSKRENLVAACRRCNSEKGNLPFSLWAAESTRPEVSVEAALTRLQNFNWERRDRAVKKGLIRRLKQTSEDEPIDERSLESTAYAATEIRRRLQYYFEENCGANSPQPEILVLPGAVTREARRAGGFDSRIKLRGKNDKDRFDARHHALDAAIMTVVDRSVARTLQQRSDLKYSNFLTGAEPRWKDFKGDSPESRKKFERWVQTSNRLADLVSDAIVTDSIPVIFPLRLGTNRGPLHKDTVRCADWKPIAEEWSEKEIERIVSPDVHAAVTEAIGLKGGKLSATSCSNVILQNGKFGEKVALAKSSAACIQVNGGVVEIGESIHHARLFAWRGRRGAIEMGMVRVFTAELPYILKNSTHGDVLTATIPASTFSFRNTPATLRKKLLAGEAVSVGWLTQNDEIEIEVDEFACGNTSFAKFLTEIPEKRWRVDGFYDNRRLRIRPAYLSAEGLTDNHSKVVHETLEKGQFVNAGALLSASRTLLIRRTALGAPRWKLDSSGLPVSFSPLKLAEEAL

SEQ ID NO: 430 - protein, 819 aa, unidentified
  REGION 1..819: note = Description of Unknown:uncultivated organism with predicted taxonomy: Brevibacteriummcbrellneri
  REGION 1..819: note = MG3-68 effector
MNKDYAVGFDVGDRSVGVAFVEFDGDVPVKLLRAIAYRHDGGIDPTTNKTPQSRKATSGVARRVRRMRKERRRRLNELDKFLRQEGYPVEGDDRGETYEPWNARANCVIGFIEDEAQRKLELSRAIRHMARHRGWRNPWHTVAQELREEVPSSQHQKNVANAQEIFPGELDANATVGQLGAVAGKYNRLLRPRTNEKAKESGIIPVLSYKVLQCDQLDELQRICRMQRVGEDFESELLELVFGQKRPVVRAENIGRDELPGMNGHPRAPRSSLEFQEFRIRDSIANLRVKSSRRDRKGVGLASEVVNDVVDYLLEWREPDDPTWAEVAELIGIDPDLLVAPVFDDVRRMSAPVDRTSRLLEKTLSKKAFKPVLEWWNNTSFEQKSMLVALISDPTDHHEDWAVSAGIADVIASWPDGLLEELNSLNFESGRSAYSLLSLKNMNECMATRGCNLHDARKEVFDVDDSWRPTPPKIHEPVGHPTVDRVLPIVRRTIMEAHRRWGVPRSIHIEHTRSSLLGPAARAEYQREVNANRRARERSIESLREQGVADPTVATVRRFSAVQHQNGVCLYCGSTITAKPGDSGCELDHVVPRSGGGSSKRENLVAACRRCNSEKGNLPFSIWAATCTRPEVSVEAALVRLENFNWEKRDRAVKKGLIRRLKQTSEDEPIDERSLESTAYAATEIRRRVQYYFEENCGANVPQPEIFVLPGAVTREARRAGGFDSRIKLRGKGDKDRFDARHHALDAAIMTVVDWSVARTLQQRSDLKYSNFLTGAEPRWKEFKGDSPEARKKFERWIQTSNRLADLVSDAIVAAAIPV

SEQ ID NO: 431 - protein, 1110 aa, unidentified; identical to SEQ ID NO: 429
  REGION 1..1110: note = Description of Unknown:uncultivated organism with predicted taxonomy: Brevibacteriummcbrellneri
  REGION 1..1110: note = MG3-88 effector

SEQ ID NO: 432 - protein, 1055 aa, unidentified
  REGION 1..1055: note = Description of Unknown:uncultivated organism with predicted taxonomy: Planctomycetes
  REGION 1..1055: note = MG4-5 effector
MGDQQTLQATSYCLGLDVGVQGVGWAVIDLDDQGQPLGVRRTGVRCFDSGVGSETEFEKGVDEPPSTKRRQARQQRRQLWRRAQRQRRVFRALQEAGLLPPGPPTPVSRDKILRTLDADLAIQFGSLEDRIAAHLLPYRLRALALDTPLPPYALGRAFYHLAQRRGFLSNKKALKEEKEAGEVKKGIAELQEEMNRAGARALGEYFSSLDPEQRRIRNRWTARQMYLDEFDRVWEAQSRYHPRLTDELKTKVRRAIFFQRPLKSQKGLIGRCELEPRHRRAPLASLLAQRFRYWQKINDLEVIQPDGVVRPLSPEERHKLAHFLETQAEATFARIRKLLDLKKPKGSQEDFAFNLERGGEKRILGNRTAAKMAAVLGQRWAAMDDEDKRRLVNEILSFEKEAPLARRLVRAWNLDEPTAAQLAALDFEPGYAALSARAIRKLLPLMQREGMRFATARKQVYGDHLLGTRAYDALPPVAKAIPSLRNPAVCRALTEVRKVVNALVRAYGKPAMVRIELARDMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHLNDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRKVSGQLHEESNYSKPHMTVDNKGNLVEHRHIRKPLKDMSVEEVEAIVDDRVRKLVQEKLRQLGQEPKKAFADEANHPYFTTADGRLVPIHKARIRKTVATITVGPPQCPRHVAPGLNHHIEILAVRDPAGAVTHWEGELVSLFEAARRVKAGEPVVRRNHGPNKDFLFSLAKGEYVEMELQPGKRQLFRVTVISAKQIEFRLHHDARPTMLLRKTPGARVIRSPGSLFKAKARKVAVDPLGNVFPAND

SEQ ID NO: 433 - protein, 1026 aa, unidentified
  REGION 1..1026: note = Description of Unknown:uncultivated organism
  REGION 1..1026: note = MG4-11 effector
LVGYEKSFFLGDLSKWQPVSAGMVAKGNLEGGPYLNYPGPLDRGPGRWTARAYSNVGRADHNQVLNKQNRKNLSMNKKNSYVLGLDLGTASIGWSIIPLDSAAIDADNINMGVVIVDEPVDKKKKTPLNVDRRNARQQRRMKDRKNRRKVHLFNCLQRAGLLPSTPCHTPFQRQDLLNELDSTHYGLDMSGNDLDLLLYRLRAMALDEKLELYAIGRILYQLAERRGFKSNRKDTTKDNEDGEVKKAIAGLGEEIDKAGSRTIGEHFAAYDTTQKKIRQTYTSRQWYEDEFDLIWAKQSSYYPDMLTDALRKEIRDIIYYQRPLKAPKRGMCDLEKGQVRVSKSDVAFQRFRYWQVLNNLEVADGHSSFRPLRAKEKAVLVQKLEVTKKVTYKAIKKLLGFSESAVFNYEAMTDTIPGNSTIASVYAVLKDKKTKPSLELCATIAEKILAFEDTGALVKNLVRKYHINRDVAEKLAGLEFEDGVAMHSKQAIERILNKMKHEGKSYATALKELYPDRNRADKVYDLLPPVDEWTKGSTKITNPSVHRILTQLRKLVNALVREYGKPALIRIELARDLKHNVKTKSKIIAQIKSREEEREAARKGLADLGIDNPTPANIKKWVIAERCNWTCVYTGKRADKRVEFGPHPQFDIDHIQPYSRSGNDSLGNKVLCFSAENRHVKKNQTPLECYGDDEERWNEIMGRVSAITGPDRVKTYRYFITTAEENEGFTARSLTDTSYISKKAVEYVSLLFGGSIDAKGKRRVFATKGGITGRLRREWGLNVLLGGEDEKNRADHRHHAIDALVIALSTPAVIKKIGGEDTRPKEDILPPIDNLADVAREVLEKVNVVYRCSQKIRGELHDAGIERYPGRKQKRKGEVYCIGTAERTKRYVHLNSNHHMEVVEGKDGRWEAVTVPRMEVYQRCRAKRPIVNRNHGDKWYVCSLAIGDYFTVDGGEKKLYVVKMLSGQVVGYMEHNDGRLQKTSGDDMSVFRTSINKLRQKGFRKVQLDVMGRLAVGKERCPTPQF

SEQ ID NO: 434 - protein, 1111 aa, unidentified
  REGION 1..1111: note = Description of Unknown:uncultivated organism
  REGION 1..1111: note = MG4-12 effector
MPNSNAPYVLGLDLGIASVGWAIRPINPSDITVDNLKMGARIFDLAVEDDIEKGKDKPKNATRRDARSARRRLWRRRRRKLKIFNLLVRYGLLPEGDYPTPDARQDMLSALDLQLVKEYFPNATHHDQQTFTYALRALALDRELSPHAFGRALYALAQRRGFKSNKKLDGREKEGEKETSQIKQDIAELEKNVAEHARTLAEYFTTVNPEEERIRARWVGRKSYEEEFEAIWTAQARFKPELLTDELKAKIEDAIFFQRPLKSQKGKIAKCELELDENGKRYLPVARKGEPCFQKFRVWEKIINLRVWDDAVDGRYGGGWRPLTHQEQDAAYELAEKSEKVTYKALRKELGFKSIKGVKKGEAVFETGYFNLEVAEDAMIGDRTSARIWKVLNETGDTLTQEEVDQAALYILDYESEDGLRRRLLKSFPTLSDAAATKLAYDVVLEEGYGAYSSVALNKLLAVMTKKRVNQALAKMEVYKAQYGEACDLLPPLEEAVGDIRNPTVTRTLAEMRKVVNAIIRRYGKPAQIYVELARDLKRSRKQRDEIFRKNQARKKERENIEKTLQNEFYIKSPKGRDVLKYRLWKECGGICPYTGMVISPDDLFGPNSRFDIEHIIPFSRSMDDSFANKTLCYAEENRNVKKNQTPIECYGDSPKFREILERVRKTFTGEFKFRKLKLFETQEPESITEFSKACLNDSRYMSKLALRYLGVLYGAVNGCVGGQDEDEGGKRVIFASTGKVTAWIRREWRLNEILCDDDEPTGEGADVEKNRNDHRHHAIDALVISLSTPSYVQQLNRAAQLADNDAKARLFKKGNFMPPVTGFKALVAQVVDGIVVSKRVDSKVRGALHEETNLGAIAYPDPYTKKQRRKKRVFVTGLTSSKLLDSVVDPGVRRAIAEKLEEVGDAKKLADNPPRLPAHNRNFGVLIVKTAIWETNNPIRVGKGRSARFVKSGDNHHMEFYAVLDDKGNEIEWKFNIVSLYEAYERRRKHLPIVSRDFGPKTRFKFSLVKGDAIREKATGKIYFIAGLSTQGEGKGIYITGALNTCAKPVTVIKEEYSKMSKMKRGVAQGDMKGLPKEVAYFRSTNLVDLMKRFEKVRIDPLGNVERSNS

SEQ ID NO: 435 - protein, 1102 aa, unidentified
  REGION 1..1102: note = Description of Unknown:uncultivated organism
  REGION 1..1102: note = MG4-13 effector
MEQKESYILGLDLGANSIGWALLEAHPDPEEKGRLKAHGIKQIGVRIFEAGVEGEIEQGKDQSRAVDRRDARLARRRLDRISRRLSHLFYLLMSAGLLPEHPAYKTELGKKKSAKERKQERDLKAKARHEVINQLDQDLVKKWREKEPLAKETLPYILRAKALDEKLELYELGRALFHLAQRRGFLCNRKAKAKDDEELGKVNQGILELEGKIEGAGARTLGEYFSKLNPKEERIRSRWTSREMYLKEFEQIWNAQEKHYPKILTPEFKKKIWRCIFYQRPLKIQHHLIGECQYEKGKKRAPSACLAFQRFRMLQQLNNSYLISPDGEILNDGRLTKEQRERLIEVLEKKAELKFSKAKKILGLTKEYRFNFEKEDGKGEFLGNETAEKLIKVFGEERWSRFSEQEKNEIVQDLISIQHKSGLVKRGKNKWGLDDENAEEFSKINLEEGYCGLSRLALSKLIPLMETGLTYMEAVKQVYPDRLQNEAFDQLPMVINQMPELKNPVVKRVLTELRKIVNAIIRKYGKPEQIRIELAREMKKTRQQREEIWKKNKQNEEKRKQAAQAIIKEAGENPKPADIEKYLLWDECNGICPYTGKSISLKQLFSGEVDVEHIIPYSICLDNSYFNKTLCFHDENAKVKNNKTPWQAYGSDEKKWNEILERVKRFKGDAAKEKLKKFQIKDLEELDDFISSQLNDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKKVNGPLHQETFYSPPKEVQGKIICHVRKPLENLSAGDIEDIVDPVVKKKVQEKIKELGGGDPKKLFAGSSTLPPEKLPCMTAKDGRVIPIRKVRIKCVMTPFQVGDKGRERFVTSDTNHHLEIFETKDKKGNVRWDGAIVSQYEAMRRLRAGEPIVKREHGKGKEFKFSLALNECVKLLDEKGQEIVCVVKGISQLSAGPIVITLRHICDARPTSEYQKQIKMRKELKKNYDKKLAEEIEKMLPVFIFKGPDSLREAKGQKILITPLGEIRTAND

SEQ ID NO: 436 - protein, 1047 aa, unidentified
  REGION 1..1047: note = Description of Unknown:uncultivated organism
  REGION 1..1047: note = MG4-14 effector
MAQLPFSDYVLGLDIGANSLGWALVSLKDGIPQSILKVGVRVFEAGVEGDIESGKDQSRAAKRREARLHRRMLERRSRRLAKIAGLLQRAGLLPDGDLKSEESRIKVLRELDDSISARHHPTSEKPDPASAHLLPYRLRALALDQKLHPFELGRALYHLAHRRGFLSNRKAPAKDPNEEGKVNQGIHTLRQKIEESGARTLGEYFSRLDPEQERIRQRWTARDMLDQEFEAIWNAQAKHHPTILTHDFKKQLRRAIFHQRPLKIKKNLIADCELEKGQKVAPRCCLLFQRFRLLQQVNNLKVTEPTGKSRPLTRDERETLLHALETQDKLSFSEIKRLLKLRDHRFRMGEGDEEVLTGNKTAAKLREIFGDRWDELSPQERDRVVEDWWSIQKSETLRKHGVKYWRLDPEAAERLGKLALETGYCKLSKKAMRKLLPLMEEGISHAKAQEQLYGNEPPPKPFDKLPPLDRAPLPKPHNPAVHRALTEVRKVVNAIIRRYGRPSLIRVELARDLKKSKEDRKKISDQIARNRRDRERAKKALIDNGIQEPSRDDIEKWLLYEECNGICPYTGKSISLASLFGPNPQFDVEHIIPFSRCLDNSFTNKTLCDIEENRNRKRNQTPYEAYGADPARWEEIIQRVKRFRGKAAAAKLHRFQLESVDSLEEFASKQLNDTAHASRSALRYLGLLYGSNKAGVGPDGRRRVQAGRGQVTAFLRDEWRLNSILGDLQKSRADHRHHAVDALAIALTDSRIIKTLSDAASRALSERRRRFGRVAPPWKSFLEEAKNAIAATIVSHRVSRKVSGALHEETIYSKPHTDKDGRVCHHIRKRLDKYFTRPMLDKIVDPVIRDIVRKHFQANGSDPKKAFSDPGNHPFLCAKDGRHIPIHSVRVREDRSTVQVGSGVSRRQVLTGSNHHVEIVEVEDEKGQPRWEGRIVTLIEAIKRLRNRQPIVQRDHGEGKKWVFSLAGGETIQLTDGGITKLYTVRTITVRRGQYVEIAYVPISDARTKTEIREKKEWRTDLLEPLRKLQCRKVLVTPLGEVRYARD

SEQ ID NO: 437 - protein, 943 aa, unidentified
  REGION 1..943: note = Description of Unknown:uncultivated organism with predicted taxonomy: Thermoguttaterrifontis
  REGION 1..943: note = MG4-15 effector
MKTKNGQVDYVLGIDLGVVSLGWAAIEIDNDGGQSLLGAGVRCWELSNASLEEVEKGKEEPPGQSRRQARRLRRQMFRRAQRLRRTYRVLQEMGLFLTGPRSSTARKAYLETLDQKAQEWLRTNVPDANDDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIDDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDG

SEQ ID NO: 438 - protein, 1062 aa, unidentified
  REGION 1..1062: note = Description of Unknown:uncultivated organism with predicted taxonomy: Thermoguttaterrifontis
  REGION 1..1062: note = MG4-16 effector
MKTKNGQVDYVLGIDLGVVSLGWAAIEIDNDGGQSLLGAGVRCWELSNASLEEVEKGKEEPPGQSRRQARRLRRQMFRRAQRLRRTYRVLQEMGLFLTGPRSSTARKAYLETLDQKAQEWLRTNVPDANDDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIDDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 439 - protein, 1060 aa, unidentified
  REGION 1..1060: note = Description of Unknown:uncultivated organism with predicted taxonomy: Thermoguttaterrifontis
  REGION 1..1060: note = MG4-17 effector
MNTKNGQVDYVLGIDLGVVSLGWAAIQIEGNGGRSLLGAGVRCWDLSSGSLEKVEKGKEEPPGQLRRQARQLRRQMYRRAQRLRRTFRVLQDMGLFPAGSCSSMARKAYLEKLDRQAQQWLRQHVPNSDGGGLLAHTFIYRLRAVALDHPLPAELLGRVFFHLAQRRGFLSNRRDSQKEEERGVVKQAISQLRADIEKLGARTLGEFLSKLNPHEQRIRNRYTSRRMFQDEFEQIWNTQRRHHPNSLTDSNKARLYKALFFQRPLKSQRGLVGRCPLEVLTRNHSNGQVAYIHAFRRAPMACLEAQRIRYMQRINDLEFTDPQGGARLLSPDERQKLYDLAERNEDLSFTVIRKALGIPTGKKDQGWQCNLERGGEKKLPGNRTAARIRKIIGDVAWENLGSVKQKPLVDTLIALLSPDALTEHLRTVWGFDCKIASQLAELQLEQGYHSFSRRAIRRLLPLLEQGERLNAAIQKVYGGTRLRITQHLKLPPVRQVLPTTRNPLLVRALTELRKVVNAIIQKYGIPQFIRVELARELKRSRKERAEISKRMREQQKRREEAAQKVLEELGRTATPRDIEKYLLAQECNWQCPYTGRQITVQSLLGDDPQFDVEHIWPLHRSLDDSFMNKTLCYHHENRSVKAGRTPYEAYATDPLRWQEILSRVRSFRGPFARQKLDRFQAVEIPPDFAMRQLNDTRWISKAAADYFGYLYGGRIAPTGQQRVFTVTGGLTALFRRAWNLNAVLGGNPEKNRYDHRHHAIDAIVVALTEPSMIQRFSNEAEKLIKAFPRVAVRLDPPWDTFLSDVQQHVERIVVSFRVNRRLSGALHDQTHYSPPVEEGKTKVRKRLNALSAHEVERIVDPEVRRLVQEKLKQLKMSDPKKAFATDVNLPIIHGKNHTALPVKSVRIWVNSLVIPVGDGPRRRYVVRGNNHHIEIYAVLDGQGYEIEWKGKIVSLYEAYERKKRGEPVVCRDHGPNTRFKFSLAKSEYIEWIRIDGQKELVRVVAISDNKLEFRLPYDARPSTLIREAHERIFATYRQLFERRARKVLVTPLGEVLPAND

SEQ ID NO: 440 - protein, 1062 aa, unidentified
  REGION 1..1062: note = Description of Unknown:uncultivated organism with predicted taxonomy: Thermoguttaterrifontis
  REGION 1..1062: note = MG4-18 effector
MKTKNGQVDYVLGIDLGVVSLGWAAIEIDNDGGQSLLGAGVRCWELSNASLEEVEKGKEEPPGQSRRQARQLRRQMFRRAQRLRRTYRVLQEMGLFLTGPRSSTARKAYLETLDQKAQEWLRTNVPGANNDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRTSAQIRKVIGDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLDRFQAEEIPPDFALRQLSDTRWISKAAADYLGHLYGGRIDPTGQQRVFTVAGGLTGLFRRAWNLNAILGGSPEKNRYDHRHHAIDAIVVALTEPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKQLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 441 - protein, 1081 aa, unidentified
  REGION 1..1081: note = Description of Unknown:uncultivated organism
  REGION 1..1081: note = MG4-19 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIELARDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 442 - protein, 1081 aa, unidentified; identical to SEQ ID NO: 441
  REGION 1..1081: note = Description of Unknown:uncultivated organism
  REGION 1..1081: note = MG4-20 effector

SEQ ID NO: 443 - protein, 1081 aa, unidentified; identical to SEQ ID NO: 441
  REGION 1..1081: note = Description of Unknown:uncultivated organism
  REGION 1..1081: note = MG4-21 effector

SEQ ID NO: 444 - protein, 895 aa, unidentified
  REGION 1..895: note = Description of Unknown:uncultivated organism with predicted taxonomy: Planctomycessp. SH-PL14
  REGION 1..895: note = MG4-22 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIELARDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGIVDSIRPHFEQMLVSHRPEHRLTGALHDETNYGRPHKEGGKDVVHIRKQVVGMSAGDIENIVDPTVRESVREKAASFGGDLKKWTPK

SEQ ID NO: 445 - protein, 1081 aa, unidentified
  REGION 1..1081: note = Description of Unknown:uncultivated organism
  REGION 1..1081: note = MG4-23 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIKLARDKKNPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 446 - protein, 1081 aa, unidentified; identical to SEQ ID NO: 441
  REGION 1..1081: note = Description of Unknown:uncultivated organism
  REGION 1..1081: note = MG4-24 effector

SEQ ID NO: 447 - protein, 1081 aa, unidentified; identical to SEQ ID NO: 441
  REGION 1..1081: note = Description of Unknown:uncultivated organism
  REGION 1..1081: note = MG4-25 effector

SEQ ID NO: 448 - protein, 1081 aa, unidentified; identical to SEQ ID NO: 441
  REGION 1..1081: note = Description of Unknown:uncultivated organism
  REGION 1..1081: note = MG4-26 effector

SEQ ID NO: 449 - protein, 1081 aa, unidentified; identical to SEQ ID NO: 441
  REGION 1..1081: note = Description of Unknown:uncultivated organism
  REGION 1..1081: note = MG4-27 effector

SEQ ID NO: 450 - protein, 1081 aa, unidentified; identical to SEQ ID NO: 441
  REGION 1..1081: note = Description of Unknown:uncultivated organism
  REGION 1..1081: note = MG4-28 effector

SEQ ID NO: 451 - protein, 1081 aa, unidentified; identical to SEQ ID NO: 441
  REGION 1..1081: note = Description of Unknown:uncultivated organism
  REGION 1..1081: note = MG4-29 effector

SEQ ID NO: 452 - protein, 770 aa, unidentified
  REGION 1..770: note = Description of Unknown:uncultivated organism with predicted taxonomy:Alphaproteobacteria bacterium
  REGION 1..770: note = MG4-30 effector
LNLERDYVFSIERGGEKTLKGNPTNADFRKALGERWDKMTPEERDRAVEYVHAFQRPDKIKVAAMKKWGLDEQSAEELAKISLEPDYLNLSRVAIEKLMPLLEGGFPYGALAPRYSAIGAEAVQKLLASAEAGTPFKETCETILGEPTVSSQEHDLLPPVGQALSEIRNPAVMRSLTELRKVVNGVLRHFGKPAQIRIELARELKKSKKQREAESKRNRENEAVRVKAKQTIKEITGDEHPSTDDVRRVQLFNDCRGTCVYCGETIAARNFLGRESQVDIDHIIPFSRSMDNSYANLVICHARCNRNKGDRTPFEAFSVDPESYGQIRDRVKIFAGDGRTVSEKIKRFEMDEGELEKFLGDFRNRQLNDTAYASRLAADYLGILYGGRTDREHRLRVQATAGQATARLRARWNLDSILDDGPTKHGGRASKERTDHRHHAIDAVVIGVTDQGMMERLSDAAKRGQEVGKRFARLDEPWNGFLEQVRKEVGQIVVSHRVSKKVSGALHEETIYSRPFPVGAGFKPAPTKAKPRCTDAEATEVRVRRGLSPSAKSTKQISAPEVEDIADPAVRKLVVAKLAELGGDLKKFADEKNLPFFETKDGRRIPIKRVRVSKALPTFTLGHGRSARHVASESNHHVEIYAELDQNGTEGEWDGEVISMYEAYQRLKAGRPVVQRDHGPLARFKFSLAPGEVVECDDKNGARSLFVMRKASQISSGQLQIGFAPPNDARKAREIQTSRAWLWANPNTLGDRNSRKVVVNPLGEVSESHE

SEQ ID NO: 453 - protein, 866 aa, unidentified
  REGION 1..866: note = Description of Unknown:uncultivated organism
  REGION 1..866: note = MG4-31 effector
DKEDDKNETEFKQDMAELSQLVKQHDPPYLGAYLACLNPDEQRLRGKRTSRQMYLDEFDAIWDEQSKHHGDLLTAEVQKTLHNTIFYQRPLKSQRHLRGKCSLTGKTRAPIALRIVQRFRAIQKLNDLQIVFADGTKRKLDEQERAKVFELQMTKGDVTFHSLKAKKVLGLPKDATFNLAEIDKKLIGHRTDAKLRKALGDRFDGLSEDQRDAIVQDIRSYRDTGPLAKRLKATYDLPSDIAADLSKVKLEKDRAAHATEAIRALLPLMERGIQYATARKQVYPESFASNTKTYDLLPSVNDWLKQHEKAVAIRNPAVMRGLTELRKVVNAIIRRYGKPKCIRIELARDLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHLNDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQAKVAVDKIVVSYRPDRKLRGKLHQDTLYSEEIHGTRRIRRELHSLKPNEVEKIIDPRIRSVVSKKLAELKESNPAKAFADPTNLPTLTDHNGRTTRLRKARVRVSAKPTKIGKGASERSVNLGSNYHTVISQDERGRWCETTVSLIEAMRRKEDGEPVIQTPEGHTFLYSLVKNDHVEIPNGNGMGRIMRVESISQGFVEFGEHNDARTQAERGSERFYLRSGKKWTEVRPRKVAVTHLGEVKHAGG

SEQ ID NO: 454 - protein, 1036 aa, unidentified
  REGION 1..1036: note = Description of Unknown:uncultivated organism
  REGION 1..1036: note = MG4-32 effector
MASEFILGLDVGVASIGWAIIDWDGAPCGIRLAGTHLFEAGVDPGKSDPETAMLLGREQSRAKPRRDARAMRRQTWRRARRKKKVLGALIRADLLPPGDIRTPAAIDAYMKSLDASLRDRWESKGASHRDRQLLPYRLRAAAVTREVERHELGRGLYHLAQRRGFLSNRKAPDRADEDRSEMKKAIGDLATQIAAHDPPTLGAYLASLDPDDARLRGRWTSRQMYLDEFDRIWDTQAERIGLTQAQREEIHNAIFHQRPLKDQSHLVGRCSLVDGAKRCPIGERIAQRFRVLQQVNHLRVVLDDRTERPLTPGERQAMLDALLTKGDLKVAAARRAAGLPRSATLSIERGGEKRLVGHRTDAKLRKVFGDERWASMSEEEKDAAVHDLRSVRLPATLRRIGLTRWGLDTESAEEFAGLSLEEGHAAHSREALRRLVPRMEQDGLSYSEARKDEFPGSFESDEPHDLLPALDQWDRDLRNPSVARALTELRKLVNAIVRRYGKPVRIHIELARDLKSGRGRRERIANRMRDREKEREAAASAIAREIGVADPPRWMIEKHLLAEECGWRCPYTGKGFGIHDLLGRNSQFDLEHIWPFSRSLDNSYANKTICYHEENRNRKQGRTPAEAYSEEELQAILERVRAFKGDPFLIQAKLRRFTDPIEEGFTERHLQETRYIGRLACDYLGLLYGGQVEAQGTAVSERRILTPTGGLVAWLRRGWGLNSVLSDRDEKERNDHRHHAVDAIVIACADQRAIQRLSESAERMEREGRERPYESVDPPWEGFEQSVQEAIHAVVVSHRQSRKVRGPLHKETLYSKEHNGRRRVRKRVETLSKTDVEKGRIVDERALAAIRAKLDELGEPNPAKAFKDPANLPTVRGHDGRSVTLRKVRVEVGVQPRAFGKGAKRRYAQTARNHHMAFYKRSLPGGRMERTTKLVALADMVDRSSVVDREADDGFEFAFSLAPNEFVVIKDDQGDDRLCRVLSISADDLELVEHTDGRTSTDRKGERIRFRRRALSEDPIRKVHVNYLGEVHDAGG

SEQ ID NO: 455 - protein, 787 aa, unidentified
  REGION 1..787: note = Description of Unknown:uncultivated organism with predicted taxonomy:Insolitispirillum peregrinum
  REGION 1..787: note = MG4-33 effector
MLDYTLGLDLGAASVGWAVVKEPTTDQDTDSVLHLGVHRFEAGVADPGKMGHGGEESSAKPRRDARQMRRQLWRRKRRRRLLLARLQEHGLLPAGELDTPEAIHVYLRELDQAILDRNYPSATHEQQLKLPYLLRAKAVSERIEIDELGRVLYHLAHRRGFLSNRKTDKEDDKNETEFKQDMAELSQLVKQHDPPYLGAYLACLNPDEQRLRGKRTSRQMYLDEFDAIWDEQSKHHGDLLTAEVQKTLHNTIFYQRPLKSQRHLRGKCSLTGKTRAPIALRIVQRFRAIQKLNDLQIVFADGTKRKLDEQERAKVFELQMTKGDVTFHSLKAKKVLGLPKDATFNLAEIDKKLIGHRTDAKLRKALGDRFDGLSEDQRDAIVQDIRSYRDTGPLAKRLKATYDLPSDIAADLSKVKLEKDRAAHATEAIRALLPLMERGIQYATARKQVYPESFASNTKTYDLLPSVNDWLKQHEKAVAIRNPAVMRGLTELRKVVNAIIRRYGKPKCIRIELARDLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHLNDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQA

SEQ ID NO: 456 - protein, 1066 aa, unidentified
  REGION 1..1066: note = Description of Unknown:uncultivated organism with predicted taxonomy: Planctomycetesbacterium
  REGION 1..1066: note = MG4-34 effector
MIAERRREREFILGLDLGVASIGWALLEVDESMRPTGVIRAGAHLFEAGVEGAIEQGRDESRAAPRRGARAMRKGHWRRQRRRRQVLLALQRHGLLPPGDVSTPSAVDRYIKSVDERLRETWCSNGDHRAQLVFPLQLRAAAATQDLGPHDIGRAIYHLAQRRGFLSNRRTEAVRGDEEDEGKVKSAIKDLAQAIDHSEQPTLGAYLATLDPDTERIRGRWTGRQMLLDEFETIWSRQAPKHEAMTDTAYEEIRHAIFHQRPLRKQQHLIGRCSLIPDKRRAPVAHRLYQRFRLLQKLNDLEILEPGRLQRPISAQERAIALALLEKNESVRFTTLRKKKGGLGLPKGTTFNFETDGESSLIGHRTDAKLRDVFGDDYDALSEREKDQIVEDLRSIREPAALKQRGVQRWGLAEEQAIRFASVRLEEGYGSHSLAAIRRLLPHMEEGARYAAARLAEFPESFTAVEPVDALAPVESALGKIRNPAVERALTELRKVVNAIIAEHGKPQLIRIELGRDLKRGRKEREKQSKRMAARRKQREEAKRRLLKETGIADPRRSDIERVLLADECNWICPFTGVKFGWSDLFGPTPRFDVEHIWPYSRSLDDSFLNKTICDQRENRTRKRNQTPHEAYGATPEVYERILQRVRAFSGDPWVLAAKLSRFEAESIPEGHVDRHLNDTRYMSRVACEYLGALYGGLSDEYHRRRVQSTTGGLTFELRRGWSLNSILGIGDEKNRADHRHHAVDAIVVALTGPKAIQQASRAAQRAETRGGARLFEEFEDPWPGFRDDVKAIVKSIVVSHRQSRKLSGALHAETNYSRPIHPAGAHHVRKELHKLTASDVDRIIDPRIRELVRQKLETIGEPNPKKAFAAPEHLPTITGSDGRTRTVRKARVRTGVKAKPIGKGVNRRYVAPTQGSNHHTVIVAHLNDAGEEVRWTDHPVTLLEAQQRKSNGEPVVQRDWGPGKRFKFSFASNEFIEMDADDGVRRIYRVLSLSEGNYELSEHIDGRKKTDRIQDQKRVKTEWERSKKVGTLIRERIVESAESMRRRKAGKISVSHLGEVRRAGG

SEQ ID NO: 457 - protein, 1036 aa, unidentified; identical to SEQ ID NO: 454
  REGION 1..1036: note = Description of Unknown:uncultivated organism
  REGION 1..1036: note = MG4-35 effector

SEQ ID NO: 458 - protein, 1053 aa, unidentified
  REGION 1..1053: note = Description of Unknown:uncultivated organism with predicted taxonomy: Proteobacteria
  REGION 1..1053: note = MG4-36 effector
MTYVLGLDIGARSVGWALLEKEGDTFTRIVRAGVRVFEAGTEGDIERGRDESRGATRRLKRLARRQIRRRRQRARALYRELANAGLLPAIKPSPGSPMALLIQDEINRLDHELRERYAGERAVSQLPYLLRARALDHRLEPYELGRAVYHLGQRRGFRSNRKAESGKKATEDPSKAKEEKSLVYRGIDDLKEQIRQAGARTLGEYFATLDPAEQRIRNRYTHRSMYEEEFEAIWEAQRPHHAALTRELKDRLREILFGQRPLRDTEDLVGECEWIPGEKRAPVWSLEYQRFRLLQTVNHLRVTENRSSPRPLTPEERQCLLEELEKKPKVTIAQAKRVLGLQRAEFTIEEGGQKDLPGDKVASQFHEILGQRWLELRPEQQRALVECVASAGSDEQLLEDLKQQWRLSDDQATQIVRNVHLPSGYASLSLKAIQKVMPYLEQGMDVQRARLEARIPLDRPVPVRELLPPLADSGVAVFNPAVKRALTEMRKVVNAVIRRYGKPDEIHLETARELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRALNDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHRVTGALHKETFYTRIGQNEKGGDVVRVRMPVTNLGSKEVEAIADPAVRQIVQAELKEVGGDARKLENNWPLLPNRHGKPVPIRKVRVNLNRAVVSVGKGPWQRWAEPSETHHIEIYEVEENGRRVWRGDVVSMREAIERATRGEPVTRRRGGAGVRYLFSVSKEDTLRLHGKYEGLWVVKKIAQKGQITLVSQFDARSEQNRTVFSPRVGGLQGYSAEKVVVLPIGDVVPCNE

SEQ ID NO: 459 - protein, 754 aa, unidentified
  REGION 1..754: note = Description of Unknown:uncultivated organism with predicted taxonomy: Solemyavelesiana gill symbiont
  REGION 1..754: note = MG4-37 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPREKRAPVWSLDYQRYRVLQTVNHLRVAENRCAPRPLTHEERWRLLEELEKKPKVTVAQAKRVLGLQKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVPVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWNEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDD

SEQ ID NO: 460 - protein, 1032 aa, unidentified
  REGION 1..1032: note = Description of Unknown:uncultivated organism with predicted taxonomy: Acidobacteria
  REGION 1..1032: note = MG4-38 effector
VDYVLGLDLGARSVGWALIELQGDEPKRVVAAGVRVFEAGAEGNIEEGREESRGVKRRQARLARRQTRRRRQRLRQLYRELAGAGLLPAVQASPGRPFAVAVQEAINVLDGQCRLQYQHDPCANRIPYLLRARALDEPLAPWELGRVFYHIGQRRGFKSNRKAEARDPEERSLVYDGIRRLEEEIQRTGARTLGEYLSKLDPRQERIRCRYTQRSMYEREFDAIWAAQSPHHPCLTTELRERLAAVLFSQRPLKDGAELVGSCSWDPSQKRAPAWSLEYQRFRVLQEVAHLRYADESQVWQPLDAEQRSKLVAALSTTRELDFRAIRKLLGFAGKVRFSVEAGGEKKLRGNVVAAEFIRAIGEEWNALGAERQAELVRQVALAEDDDKLREELITNWRLTPEQAGRLVADVRLPRGYAALSLKAIRAALPYLEQGMSVQQAREAAGYELMPPVPARDLLPPLASSGIEVFNPAVKRSLTELRKVVNAVVRKYGKPAEIHIEVARELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHLNDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHRVSGPLHKETFYAVSGAPAAPTGTIRTRKPVFRLTEEDVDRIADPAVRCLVKQKLAGVGEARKLEKDWPVLPNAHGQPVPIKRVRLELRDAVRAVGQGHRRRWAEVGESHHVAVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 461 - protein, 784 aa, unidentified
  REGION 1..784: note = Description of Unknown:uncultivated organism with predicted taxonomy: Planctomycetes
  REGION 1..784: note = MG4-39 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDEVLPAYALGRAFYHLAQRRGFLSNKKASAKKDDEDKGKVKAGIAELTRQIEVAGARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDVEHIIPYSRCLDNSFANKTLCEVAENRAAKKNRTPYEAYGNAPQRWHEILQRVSRFRGDAAKAKLRRFQLTEIPADFANRHLNDTRYSSRLASEYLSLLYGGRSDAQGNLRVQASTGAVTSLLRDQWGLNAILAELGRQLGVSGLDDDVEKARFDHRHHAVDALVIALTTP

SEQ ID NO: 462 - protein, 1106 aa, unidentified
  REGION 1..1106: note = Description of Unknown:uncultivated organism with predicted taxonomy: Thermoguttaterrifontis
  REGION 1..1106: note = MG4-40 effector
VDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSAGDQKDGEDRKNKKNKKGKKSEKSERERIRAAISQLQQAMQTSGARTLGEYFARLDPHQERIRGRWTSRRMYKEEFEAIWTAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLRALSEHDPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 463 - protein, 811 aa, unidentified
  REGION 1..811: note = Description of Unknown:uncultivated organism with predicted taxonomy: Planctomycetes
  REGION 1..811: note = MG4-41 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDRPLPVYALGRAFYHLAQRRGFLSNKKASAKKDDEDKGKVKAGIAELTRQIEAADARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHLNDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPP

SEQ ID NO: 464 - protein, 1111 aa, unidentified
  REGION 1..1111: note = Description of Unknown:uncultivated organism with predicted taxonomy: Thermoguttaterrifontis
  REGION 1..1111: note = MG4-42 effector
VDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSGGEQKDGEDRKNKKNKKGKKSEKSERERIRAAISQLQQAMQTSGARTLGEYFARLDPHQERIRGRWTSRRIYKEEFEAIWAAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLQALSQHDPKLADPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 465 - protein, 1111 aa, unidentified; identical to SEQ ID NO: 464
  REGION 1..1111: note = Description of Unknown:uncultivated organism
  REGION 1..1111: note = MG4-43 effector

SEQ ID NO: 466 - protein, 1056 aa, unidentified
  REGION 1..1056: note = Description of Unknown:uncultivated organism with predicted taxonomy: Proteobacteria
  REGION 1..1056: note = MG4-44 effector
MSGENIETILGLDLGANSVGWALIECVDGKARRILGMGSRIFEAAIEGDLEKGQEEPRAVERRMARQMRRQHKRRVMRMIRVGELLQQAGWFPPGNLRDSVERDRILKELDKSLRQQYADRGFHLSGIDAIRGIAYFLRARALDEPLEPYALGRAIYHLAMRRGFLSNRKAPMKKDEELGAVKKGISDLESEMKQCQARTLGEYFYKVDPVHEKRIRKRWTARQMYKDEFDTILQQQVKLGAIRDDPKFFRKLRKAIFRQRPLKSQCGLIGPCQFEKNEKRAPWHNLLAQEFRLLQKINDLRLIDPSTREERPLNAEERKILYDWLMEHGEATFAELRKKLGFNPRDGQKFNLEAGDETRLKGNEVAARLIAVLGEERWRGITDQEKAQLISELNSDITEERLRYRAEKVWGITDPERVDKLVKLTLPKGYCSLSKIALKKLVPLMREGKDYVTAAREVYGDLQYKNQTFDRLPPFLKVDRTLRSPVVIRTLSETRKVVNEILRVFGRPNRIHIELAREMKQSRIQRQKRYQTMRDREKMRNQARQSLQAELGWDPNDIKGRDIEKWLLAEECSWVCPYSGKPINYHNLFGEKAEFDIEHIIPYSKSLDDSFVNKTLCHREWNQKKGNRTPAQAFKNTPEWEAMLQRVRAFKPLHAVHMKKGESSKRNPKYDLFCMEEIPPDYVDNKLNDTRHAAKVAMGYLGLLYPKEERLKRVKAFAGGVTGELRKCWKLNSILGDPDSVEPKKNRADHRHHAIDALVLALATPGMVQYLSKAAAQQLACQRSIRGYQKFMEDPWPHFLEDVRKAVNAIVVSHRVDHRLQGRLHNDTLYSPPRVDENGKTYHVVRKPLDGNFKKVGDIEDPEVRRIVQEHLADHDGDPKKAFNDPDNHPKINDIPIHAVRVRDYVKPEKIGKDFCPRYALTDSNHHMEIIEEKDKKGNPRWTAIVVSRFEAMQRKIRGEPIVQREHGEGRRFVCSIASGDTFSYREKEDGPGIFARVRSIWKQNVEFVQINDARLKAEIKKENEWYVRSVNELRKMGFQKVSVSPIGEVYPAND

SEQ ID NO: 467 - protein, 1056 aa, unidentified; identical to SEQ ID NO: 466
  REGION 1..1056: note = Description of Unknown:uncultivated organism
  REGION 1..1056: note = MG4-45 effector

SEQ ID NO: 468 - protein, 1111 aa, unidentified; identical to SEQ ID NO: 464
  REGION 1..1111: note = Description of Unknown:uncultivated organism
  REGION 1..1111: note = MG4-46 effector

SEQ ID NO: 469 - protein, 1056 aa, unidentified
  REGION 1..1056: note = Description of Unknown:uncultivated organism with predicted taxonomy: Proteobacteria
  REGION 1..1056: note = MG4-47 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPDEKRAPVWSLDYQRYRVLQTVNHLRVAENRSAPRPLTHEERWRLLEELEKKPKVTIAQAKKLLGLKKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVTVHPLLPPVADSGVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDRQAEARPVKSRDDHRHHAVDAVVVALCNQGWIQRLSEANRGALAARRRLFAPVEPPWVGFKEQLKDILKSMNISFRPDHRVTGALHKESHYGYSKVSESDNPVFKIRKPVYELTKSMVQKIVDPAVRSAVQEKLAAVGGKVEALKGNWPVLQSKNGQSRPIKKVRIQVALSPIEVGKNHRKRFVEVEDTHHMEVFEVPGRLSKWKARVVKMHEAAARLVCGANIFDRHLDSKSRYLFSLMKGDCLQMHGEMSGIWIIKTIRANTQIELVSQYDARPVGSSKGGARVTRKCISEFQKFSPRKVVVLPIGDVVRCNE

SEQ ID NO: 470 - protein, 1026 aa, unidentified
  REGION 1..1026: note = Description of Unknown:uncultivated organism
  REGION 1..1026: note = MG4-48 effector
VRQDEHGTVHIVDSGVRVFPWTIEEDTLKSRNIERRTARHRRRQLERRARRRRVLARLLHHYGFLPPWPADWRTFDFHRDPAWGPLLAKDPYELRAKALDQLLEPWEFGQVIYHLAHRRGFAGFRKVRDDEELGNIRREIEQLDQEIKRSGARTLGEYLAQLDPRERRRRGRHTSRDWYRAEFELIVATQQRLGLPLTPDMVRTLRRAIFHPRPLKVVPSAIGRCPLVRGRRRAPQGLREAQEFRYLQNLANLRIILPNGVQRGLTPPERKTVIQHLEQVEEMTFNELRKLLFADRVESARSRSQTAPERSHTPAAVTADGRTPAAMPVDTTVPSTMEQWNPGWKLQDIRFNLEEGEREEIEGNVTAARIRKAIGAKWDPATPDIRRAMVEMWIGIEDEDVCKQVALRQTEWGLTESEAEALSQVAFEGGRCRFSSTALRRLLPHLRQGRSLYDAIQQEFPEHGEQVALDEVPPLGEEIPNPLVRRALSETRRIVNAILTTYGKPSEIHIELARDLRRPLCEVREMIKQMRKREKMRREAERKLCEEHGIRKPTAREIEKYLLWKECNARCPYTNQDIRAEALFGSHPRFDVEHIIPWSRCLDDSFANKTLCEAKHNREQKRNRMPTEAYSREALEQIWERVRRFQGDYAAEKLRRFQMDPPPELHLIHRGDQLHATAYAARVAARELARLYPNQERAHRIWVSSGRATACLRDAWQLNQLLGRKDEKNRADHRHHMVDAVVVALTTPKIVQDLTHAAQNAVRARRFQGMEPPSGLHEALRQRLEKVIVSHRVERKVQGPLHEETFYGLIRSPETGEIRPVVRKRIDTLTLNEVKNIVDPNIRQIVLERCGEKDPKTVFKDPQQIPWLDFGSKRVRLRRVRIYVNQEPIEIGQNPPRRCFTGSNHHLEIFDCRGQWRCEVVSRWEAMRRLRAGEPVVRRQDAHGCPLVFSLARGDTVELKWKSGTLIAVVQKFSERDYTFRAHDDGRMDKEIREDRIRIRSDRRLQEVLVRKLSVDVLGRAYVSRE

SEQ ID NO: 471 - protein, 1088 aa, unidentified
  REGION 1..1088: note = Description of Unknown:uncultivated organism
  REGION 1..1088: note = MG4-49 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDEVLPAYALGRAFYHLAQRRGFLSNKKASAKKDDEDKGKVKAGIAELTRQIEAADARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHLNDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPPWGTRAQFVADVRNAVLAINVSRRVDRRLKGPLHEETIYGKPKQCVDEKGKTIQVAHVRKPLESLSPNNVDHIVDPVIRELVKKKLQELGTTDPKKAFQAKDNHPYMKARDGRIIPIHKVRIRVPTETLMAIGHGPTLRHVKPGVNHHMEIVATLDAAGNEIRWEGITVSLFEALQRLRNKQPVVQRDHGPGKRFKFSLSGGEYLEFVENGRNKLVRVSVISGDDVEFRLHNDARPNTMLRGVKGARAGLVRSADALRKLKARKVLVDPLGNILPAND

SEQ ID NO: 472 - protein, 770 aa, unidentified
  REGION 1..770: note = Description of Unknown:uncultivated organism with predicted taxonomy: Solemyavelesiana gill symbiont
  REGION 1..770: note = MG4-51 effector
MALVLGLDLGARSVGWALLEKQGDNWTRIVRAGVRVFEAGTEGNIEQGRDQSRGATRRIARLARRQIRRRRQRARALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRDLKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGETNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETGISRDDVRKAMLWEECNGMCPYSGRSLGGFASLFSGNSPAQIEHIIPFSRSLDNSFVNLTLAHVSENAYKGDKTPWEAYGSNPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQ

SEQ ID NO: 473 - protein, 1053 aa, unidentified
  REGION 1..1053: note = Description of Unknown:uncultivated organism
  REGION 1..1053: note = MG4-52 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQCPLRDTEDLVGECAWIPGEKRAPVWSLDYQRYRVLQTVNHLRVAENRSAPRPLTHEERWRLLEELEKKPKVTIAQAKKLLGLKKAEFTIEEGGEKELPGDKVAAQFYEKLGESWSRLNPEERRALVECVATAETDEQLSETLQQQWGLSADQANKVVREVHLPSGYAPLSLKAIRAVMPYLEQGMDVQRARLAAGIPLDHPVSVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQWVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVDEKGKKVWRGDVVSMREATERAARGTPITHRRGGVNTRYLFSVSKEDTLRLHGEHEGLWVVKKIAQKGQITLVSQYDARPEQGRTVFSPRLGGLQVHSAEKVVVLPIGDVVRCNE

SEQ ID NO: 474 - protein, 1055 aa, unidentified
  REGION 1..1055: note = Description of Unknown:uncultivated organism
  REGION 1..1055: note = MG4-53 effector
MSSYILGLDVGANSIGWAVVPLQNGAPAGVTRAGVRVFAAAVANLEEAQPETANAQRRLARLTRRRLDRLARRLEHLFRLLQRHGLLPPDPAPSPPASRLEAAHRRHDLLRRLDADLLSEWAARGARGEVPLPDPATLPHVLPYLLRARALDEKLSPYALGRALYHLGQRRGFLSNRRAGAKEEEGEVKKGIDSLAAEMAAAGARTLGEYFSRLDPQSARIRGRYTSRRMHEDEFALIWAAQCVHYPDRLTDDLKKQVHHAIFYQRPLRFRKDAIGPCQFELNRRRAPMALLACQRFRLLQSVNHLQVLLPDGRPRPLAESERQALIAALEEQGDLKFAQVRKLLALPRDTAFNLERGGEKKLPGNRTAAALRAVFGAARWAQLTPADRDRLVDDLRSIQQDEALVRRAMRVWGLDAAAAQQLAAVRLEQGYLNLSRQAVAKLLPLLEAGKPYATAVAEVYGPRPAPPPVDQLPLVSAALPHLTNPVVQRALTEVRRVVNALIRQYGKPECIRVELAREVKKNARQRHQIALRNRENERLRRAAAERIVREVGIANPSRADIEKVLLAEECNWHCPYTGKPISMAALFGEHPQFDVEHIIPFARSLDDSFMNKTLCDAEENRRVKRGRTPFEAYGSQPERWAEILRRVRAFKGSAADAKLERFRCESPPDATELCSRLLNDTRYAARAAAEYLGRLYGGQSDAGHRRRIQVATGQVTAFLRREWGLNAILGDGDEKSRDDHRHHAVDALCVALTDAGIVQALAAAAARAPAEGRRCFARLAPPWPSFLADARRAVLEITVSHRVRRKVSGPLHAESFYSRPHRDPQGRECRHIRKPVEALSPDEVAAIVDDKVRECVRAALRAKNLDPDAIRNSRAIAQAFASPADHPCLVARDGRRIPIHRVRIRKVVNAFTLGDRHVVTETNHHVEIFARLNPDGEVARWEGKVVTLLEAVQRLRAGLPIVNRDHGPDTRFLFSLALREAVRMDDGQGGRMLCVVVVVSQTQQGRIDLEFRRHHDARPGMQGERIRKTPNSLRLAHAEKVVVDPLGRVWPAHD

SEQ ID NO: 475 - protein, 813 aa, unidentified
  REGION 1..813: note = Description of Unknown:uncultivated organism
  REGION 1..813: note = MG4-54 effector
EFDAIWAAQSPHHPCLTTELRERLAAVLFSQRPLKDGAELVGSCSWDPSQKRAPAWSLEYQRFRVLQEVAHLRYADESQVWQPLDAEQRSKLVAALSTTRELDFRAIRKLLGFAGKVRFSVEAGGEKKLRGNVVAAEFIRAIGEEWNALGAERQAELVRQVALAEDDDKLREELITNWRLTPEQAGRLVADVRLPRGYAALSLKAIRAALPYLEQGMSVQQAREAAGYELMPPVPARDLLPPLASSGIEVFNPAVKRSLTELRKVVNAVVRKYGKPAEIHIEVARELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHLNDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHRVSGPLHKETFYAVSGAPAAPTGTIRTRKPVFRLTEEDVDRIADPAVRCLVKQKLAGVGEARKLEKDWPVLPNAHGQPVPIKRVRLELRDAVRAVGQGHRRRWAEVGESHHVAVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 476 - protein, 950 aa, unidentified
  REGION 1..950: note = Description of Unknown:uncultivated organism with predicted taxonomy: Flavobacteriumhercynium
  REGION 1..950: note = MG4-55 effector
LKELDKSLRQQYADRGFHLSGIDAIRGIAYFLRARALDEPLEPYALGRAIYHLAMRRGFLSNRKAPMKKDEELGAVKQGISELEREMKQCQARTLGEYFYKVDPVYEKRIRKRWTARQMYKDEFDTILQQQVKLGAIRDDPKFFRKLRKAIFRQRPLKSQCGLIGPCQFEKNEKRAPWHNLLAQEFRLLQKINDLRLIDPSTREERPLNAEERKILYDWLMEHGEATFAELRKKLGFNPRDGQKFNLEAGDETRLKGNEVAARLIAVLGEERWRGITDQKKAQLISELNSDITEERLRYRAKKVWGITDPERVDKLVKLTLPKGYCSLSKKALKKLVPLMREGKDYVTAAREVYGDLQYKNQTFDRLPPFLKVDRTLRSPVVIRTLSETRKVVNEILRVFGRPDRIHIELAREMKQSRIQRQKRYQTMRDREKMRNQARQSLQAELGWDPNDIKGRDIEKWLLAEECGWVCPYSGKPINYHNLFGEKAEFDIEHIIPYSKSLDDSFVNKTLCHREWNQKKGNRTPAQAFKNTPEWETMLQRVRAFKPLHAVHMKKGESSKHNPKYDLFCMEEIPPDYVDNKLNDTRHAAKVAMGYLGLLYPKEERLKRVKAFAGGVTGELRKCWKLNSILGDPDSVEPKKNRADHRHHAIDALVLALATPGMVQYLSKAAEQQLACQRSIRGYQKFMEDPWPHFLEDVRKAVNAIVVSHRVDHRLQGRLHNDTLYSPPRVDENGKTYHVVRKPLDGNFKKVGDIEDPEVRRIVQEHLAAHDGDPKKAFNDPDKHPKINDIPIHAVRVRDYVKPEKIGKDFCPRYALTDSNHHMEIIEEKDKKGNPRWTAVVVSRFEAMQRKIRGEPIIQRNHGEGKIFVCSIATGDMALVDLEPTNPNVLVRVRGISFNEVSLVRANDARQKKEIVSSGDFIRKTPLMLQKMNFRKVSVSPIGEVYPAND

SEQ ID NO: 477 - protein, 878 aa, unidentified
  REGION 1..878: note = Description of Unknown:uncultivated organism with predicted taxonomy:Pseudoxanthobacter soli
  REGION 1..878: note = MG4-56 effector
SGAGLLPPITPVPGSPMAVLIQEAINRLDCELRRKYAGERAVSQMPYLLRARALDHRLEPYELGRAVYHLGQRRGFRSNRKAESGKKATEDPSKAKEEKSLVYRGIDDLKEQIRQAGARTLGEYFATLDPAEQRIRNRYTHRSMYEEEFEAIWEAQRPHHAALTRELKDRLREILFGQRPLRDTEDLVGECEWIPGEKRAPVWSLEYQRSRLLQTVNHLRVAENRCAPRPLTPEERQCLLEELEKKPKVTIAQAKRVLGLQRAEFTIEEGGQKDLPGDKVASQFHEILGQRWLELRPEQQRALVECVASAGSDEQLLEDLKQQWRLSDDQATQIVRNVHLPSGYASLSLKAIQKVMPYLEQGMDVQRARLEARIPLDRPVRVRELLPPLADSGVAVFNPAVKRALTEMRKVVNAVIRRYGKPDEIHLETARELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRALNDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHRVTGALHKETFYTRIGQNEKGGDVVRVRMPVTNLGSKEVEAIADPAVRQIVQAELKEVGGDARKLENNWPLLPNRHGKPVPIRKVRVNLNRAVVSVGKGPWQRWAEPSETHHIEIYEVTSRGKTAWSGDVVTMRDAIGR

SEQ ID NO: 478 - protein, 911 aa, unidentified
  REGION 1..911: note = Description of Unknown:uncultivated organism with predicted taxonomy: candidatedivision Zixibacteria bacterium CG_4_9_14_3_um_filter_46_8
  REGION 1..911: note = MG4-57 effector
MEGKKVGGYILGLDIGANSVGWAILSQKDGKPTGIVKTGVRVFEAATEGDISAGKDESRNKKRRQMRLQRRQAERRARRKRKVFNLLVKSGLLPPGHITGVINDIDKAAYAKYVASADKSARPILAHVVPYILRARALDHPLSREELGRALYHLCQRRGYKSNAKMQEDEKEKGEVKEGIGKLEQAIKASGARTLGEYFSKINPEEERIRQRWTSREMYENEFEQIWEAQKKHYPELLTDALKEKMRDAIFHQRKVTWDKNTIGDCELEPGQKRAVAALLICQRFRFLQRLNDLKIISPLGEIVDLTPEQRRALAEKLDVEGDLSWTKVRKILQLTKEHHFNLEKVSDKGLIGNRTAGKLHKIFGDKWLSFTEEQRNRIVDDVRSFEDRRALALRAMKTWGLTDEKAADLAAVAFEPDYFNLSLRAIRKLLPLLENGMPFATARDQVYGKPKPVEPVDALPVVNEALPALRNPVVARSLTQLRKVVNNIIREYGKPAAIRVELARDLKRSKKQRQTLTERIRSREKLREDARKRLENEKLVERPTRNDIDKVLLADECNWICPYTGRQIGWKTLFGPSPQFDIEHIIPFSRCLDDSLANKTLCDIEENRNVKRNRTPWEAYGSNPEKWGQILDRVRRFKGDDAILKLQRFQLKDVGDFEEFSSRQLNDTRYASVLAAKYLGALYGGAIDAEHTRRIQVSAGMVTAYLRNEYGLNPILGDGGEKSRDDHRHHAIDAICVALTDAATVKMLSDAASRALSERRRQFGHIDPPWPSFLADVRKHIDDLIVSHAVSRKVNGPLHEETLYTKPRIDKDGNQVVCVRKPLDALSESEAKQIVDPVIRKMVLDRIEKEGAPPKKVFADKSRHPVICGKNGTRIPVHSVRIAKTGSVIPIASGGRSRNIMPGSNHHMEI

SEQ ID NO: 479 - protein, 976 aa, unidentified
  REGION 1..976: note = Description of Unknown:uncultivated organism
  REGION 1..976: note = MG4-58 effector
SGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPREKRAPVWSLDYQRYRVLQTVNHLRVAENRCAPRPLTHEERWRLLEELEKKPKVTVAQAKRVLGLQKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVPVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNPPAQIEHIIPFSRSLDNSFVNLTLAHVSDNAYKGDRTPREAYGSDPERWNEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 480 - protein, 1057 aa, unidentified
  REGION 1..1057: note = Description of Unknown:uncultivated organism with predicted taxonomy: Proteobacteria
  REGION 1..1057: note = MG4-60 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRTRYTHRSMYEEEFEAIWEAQRRHHAALTRELKDRLWQILFEQRPLRDTEDLVGECAWIPGEKRAPVWSLDYQRYRVLQTVNHLRVAENRCAPRPLTHEERWRLLEELEKKPKVTIAQAKKLLGLKKAEFTIEEGGEKELPGDKVAAQFYEKLGESWSRLNPEERRALVECVATAETDEQLSETLQQQWGLSADQANKVVREVHLPSGYAPLSLKAIRAVMPYLEQGMDVQRARLAAGIPLDRPVSVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 481 - protein, 1111 aa, unidentified; identical to SEQ ID NO: 464
  REGION 1..1111: note = Description of Unknown:uncultivated organism with predicted taxonomy: Thermoguttaterrifontis
  REGION 1..1111: note = MG4-61 effector

SEQ ID NO: 482 - protein, 1054 aa, unidentified
  REGION 1..1054: note = Description of Unknown:uncultivated organism
  REGION 1..1054: note = MG4-62 effector
MSTPSNVPYVLGLDLGVASIGWAVLDTDAKGRPTSIRAAGSHLFEAGVGGGSQSTPEMAMARGKEESKAAPRREARAMRRQTMRRARRKKKLLGALIRHGLLPEGDIRTPAAIDAYVKALDAALRATWCPPGSSHVEYQNMAYRLRAEAAQRPLDAHAVGRALYHLAQRRGFESNRKTPKRDDEDTSDFQNKLDDLGDAIRSHTTQTLGAYLASLDPDEKRLRGRWTHRSMYEQEFETIWDAQAGALGLDGGAKQDIHHAIFYQRPLKDQSHLVGRCSLVPGKKRAPIAMRIAQDFRVLERVNHLRIVHDDHSERPLSKDERDNLLAALRREEKLTMHQAKKAAGLPTKHVKFSIEAGGETKLVGHRTDAKLCKIFGDRWDEMSEQEKDTVVEDVRCVRLPDTLRRIGEVRWGLSREKAQELADVQLEEGHSAHCLRALRKLVARMDADGLAYSTARKDEYPASFQSVEPMDLLPPVDAWEKDLRNPAVSRALTELRKLVNAIIDRHGKPVRIHLELARDLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHLQDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQRVRGPLHKDTIYSPKIDGKHRVRKELHKLTAKEVQSGKIVDTRALAAIQAKLAELAKTDPALADPAKAFKAPENAPLVPGPNGSKVRLRRVRIDTGDKPTRFGGAKGKGSARYAKNELNHHVAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGG

SEQ ID NO: 483 - protein, 787 aa, unidentified
  REGION 1..787: note = Description of Unknown:uncultivated organism with predicted taxonomy: Planctomycessp. SH-PL14
  REGION 1..787: note = MG4-63 effector
PAGPASITQAKTAVNKLSDADKKDVAIVAITLDPEGDTRTDQWKRIRGRRTHRAMYVEEFEHIVQRQADFHPVLKDKAFVRRLSHAIFDQRPLKSQASLIGVCDLVPGRRRAAIASLPYQRFRLLQKLNDLSYVDHDGQKKRPTENQIRPLREKLQTEGDLTWATVGRLLGLDRKSKETGLPRLSHEEGGDKKLIGDRTSAKLRRVMAQKLDALSVAEQTAIIDEILSYGDVEEKLAERLRKAWQLTDAEAAEVAALRFEPGYGSVSRTAIARLMPHLEQGTPYATARKIEFGEVEESVPWPLLPPQGDNAKLWKENKKPDRLVYQSFSNPTVARCLSEMRKVVNALIRRYGKPAYIRVELARDLKNSRSRRADLTTRRNRNQARRERAKEAIEKECNNSRPSRFDIEKWLLAEECGFQCPYTGQSIPRHRVLSAEFEVEHIVPFSRSLDNSFTNKTLSHRDANAKKGNRTPMEAFGQPEEKWEQILARVKRFDGPFARRKLDLFQQRTPPEADFYERQLSETRYIARQAADYLGLLYGGRIEQRAGDEVGRRRVLVTPGRATALLRNGWQLASVTGGLKNRQDHRHHAIDALIVGLTQDGFLKQLSEAAARADELQLTRLTTEMDSPWETFLDDVGKGYERIHVSTRPTRKLNGPLHKETVFSKPHEASGSAKVFHAVRRPLQLMTKSEVGNIVDKRVREAVLEHLDRHDGDLTAAFGDPNNHPQLPCKDGRTIPIHRARVQRREKPWPIGKKSSKRYVVPGANHRLEIIARLNEEGEEIRWLGNI

SEQ ID NO: 484 - protein, 1054 aa, unidentified; identical to SEQ ID NO: 482
  REGION 1..1054: note = Description of Unknown:uncultivated organism
  REGION 1..1054: note = MG4-64 effector

SEQ ID NO: 485 - protein, 1041 aa, unidentified
  REGION 1..1041: note = Description of Unknown:uncultivated organism
  REGION 1..1041: note = MG4-65 effector
MPEQPKMTYVLGLDLGAESLGWAILETRDGEPVRIERTGVHTFEAGVEGDIESGKDESRAKARRDARLPRRQLWRRAARRRKVLHILQRHGLLPPGEARTPEQIHDLLLKLDADLRAAYLPAGDEVAAHLLPYRLRAKALDEKLEPWALGRVFYHLAQRRGFLSNRRSPERKDEDEGKVKAAIGELAADMKARGARTLGEYLAGLDPRCQGVRRRWTARTMFLEEFDRIWAAQAPHHPCLTEELRGQLRRALFFQRPLKSQKALVGRCELIPDRRRVALALPIAQRFRLLQKVNDLKVREPEGTERFLTPQEREKLARELDDKGDLKFDKVRKCLGLPRGVTFNLQEGGEEKLPGNRTYAKLKAVLGARWGGLSAADREQIVVELLSFQKPEALARRLMKVWNLDEPSATKLAEVRLEQGYARHCRKAIARLLPLMESGVPYATARKEVFPESFAAGTPVDRLPPVTDVLKDLRNPAVCRALTELRKVVNAIVRRYGKPECIRIELANDLKRPRKQREEISKRNRGRQKDREEAAEAIRSALPGLEPRRADIEKWLLAEECNWRCPYTGRSINAAALLGSTPQFDVEHIWPMSRSLDNTFANKTLCYHEENRARKGNRTPLEAYGSDPQRWEEILQSVRRFNGPLAWEKLRRFMAREIPQDFTDRQLQDTRYACRLAADYLGRLYGGRVDAQGKMRIEVRPGGLTAHVRNELMLHAILDDGGAKTRADHRHHAVDALAVGLTSQSMVQQLQTAAGRALQAGRRLFAPVPEPWTGFLEDARRSIGQIIVSRRPDRKVAGKLHAETFYSKPIPGADGDVRHVRKELRKLTLGEIQGDRIVDPVIRRLVQERHRQLGGGKPDSVFADPASHPVLRTRDGREVPIHKVRIRSKEKPWPIASGSRLRYVVAGGGTNHHLAIVARPGRRGRGEYWEDHIVSRYTAQQRLARGEPVIQKDWGPGRRLVMVLMPNDFIVMPDDRGVQQVYRVLSISEGDTELRLHCDARRAEDLKKARERVRVSGEKLRKLGGRRVEVSLLGELIGAHD

SEQ ID NO: 486 - protein, 1088 aa, unidentified
  REGION 1..1088: note = Description of Unknown:uncultivated organism
  REGION 1..1088: note = MG4-66 effector
MLQPLQVPYILGLDIGVQSIGWALVRLDEEGNPCGILRLGVRSFESSSGSEQEIEKGTDEPASRQRREKRLMRRQLFRRQQRLRRTARVLQQAGLLPPFPLQPASRDAAITQLDAQLRSQFIDSGNHVDAQLLPYRIRAAALDQPLPAYALGRAFYHLAQRRGFLSNKKAGGKKDEEEKGKVKAGIAELAKQIEAAGARTLGEFFARLDPHQQRIRSRWTSRKMYQQEFDAIWAAQEPHHPQILTAELKAKLYRAIFFQRPLKSQKGLIGRCSLEKGRRRAPLACLEAQRLRYWQKLNDMRLKDARRILNAIPEAEGLIDWLPQEGQGRLSLYAKQLLAQHLETSEELTFNQIRHILGLKKKKNSDLDFTFNLEEGDEKKLLGNRTAARLLKALGQRWQDMPEDQRQRLVDEILSFEKEEPLARRLEKAWGFTPAEAANVAALDFEQGYHSFSRQAIRKILPHLQQGQSLASIIKQLYKDTQPQATAWDRLPPLRDVFPHVNNPVVRRALTEVRKVVNAILRVYGKPQQVHIELARDLKKSRYERQQLFKGMRQQQKQREEAKSWLQCQMGITNPTAHDILKYRLWIECNQQCPYTGKPISKEALFGREPQFDVEHIIPFSRCLDNSFTNKTLCEIAENRNVKKNRTPYEAYGHDPQRWHEILQRVSRFQGDAAKAKLRRFQLTEIPADFANRHLNDTRYSSRLAAEYLALLYGGRSDAQGNLRVRAITGAVTAQLRDQWGLNAVLAELGRQLGVRDLDDNVEKARFDHRHHAVDALVIALTTPGMVKRFSDESQRARQYGRQLRCFFDPPWGTRTEFVADVRNAVLAINVSRRLDRRLKGPLHEETIYGKPKQYVDEKGKTIQVAHVRKPLESLSPKNVDDIVDPVIRELVKKKLQDLNTTDPKKAFQKKENHPYMIARDGRIIPIHKVRIRVTTETIMTVGHGPTLRHVKPGTNHHMEIVATLDAAGNEIRWEGITVSLFEALHRLRNKQPVVQRDHGPGKRFKFSLAGGEYLEFVENGQKKLVRVTTVYHSNVEFRLHNDARPITMLLGVKGARAGLGHSVDALRKLKARKVLVDPLGNILPAND

SEQ ID NO: 487 - protein, 1042 aa, unidentified
  REGION 1..1042: note = Description of Unknown:uncultivated organism with predicted taxonomy: Proteobacteria
  REGION 1..1042: note = MG4-67 effector
MSISDLSPSYILGIDLGAESIGWLLLDVDGDRPTAIRRAGTHCFDAAVEGDLESGKDESKAKARRDARSPRRQHWRRARRRRRVLRTLQQAGLIPPGPLASPIDIHELILRLDQALREKFIPADDRVAAHLLPYRLRAKALDERLEPFEVGRALYHLAQRRGFLSNRKAGKKGDDEGMVKAAISELSDRMTAAGARTLGEYFSGMDPEEERIRKRWTSRQMYLDEFEKIWTKQAEFHPQMTDEVKAQIHAAIFFQRPLKPQTHLIGVCDCDPPHRRAPVALRLAQRFRLLQKVNDLEVLEPTGFPRPLSSDERAKLIAALEQSGDLTFAKIRGKSILALPKETSFNLEKGGEKKLPGHRTDAKLAEIFGDKWPRLSEAERDQIVEDILTFEKSEALAARAQRAYGLDREAALRLAELELEPGYAMHCRKVLRQLVAKMEGGTRYAAARRELYPDQFQAKPAVDLLPPVKDALRNLRNPAVCRALTELRKLINAIIRRYGKPAEIHIELARDLKRSRKDRQELSKVIRENEKLREKAKERILRELGDQQPTRADIEKVLLAEECGWECPYTGKRFGMQELLGQNPQFDVEHIIPLSRSLDNSFGNKTLCYHEENRNHKRNRTPWEAYHADEQRWHQILERVRRFQGASARGKMRRFLMEAIPDDFTSRQLNDTRYASRLAAEYVGLLYGGRADAEHRQRVYVCTGGTTAFLRNEWKLNTILGDGGPKTRDDHRHHAVDALVIALTGPATVKMLADAADNPWQHRRRLFAPIQEPWVGFLDQAREAILRINVSHRVNRRVAGPLHDESIYSPPQRGVGSSPKVVPSYHIRKPLASLSIHEVEDIVDPIIRARVKAVLDEKGGDPKKVFSVAANLPALRTRDGRTIPIRKARIRKSQNMVAIGKGPTQRYVAPGSNHHMAIVAKVDSEGNDREWEGVLVSRLEAAERARRRVPVVQREWGEGRVFRFSLAPGEMFTLEDGNGKGLYIVRSISQNRVEFVKANDARKKVDIKAAKHWLTHPPSVLFRKRCQKVSVGYLGDIVPAND

SEQ ID NO: 488 - protein, 1061 aa, unidentified
  REGION 1..1061: note = Description of Unknown:uncultivated organism with predicted taxonomy: Thermoguttaterrifontis
  REGION 1..1061: note = MG4-68 effector
MSAECQVRANEKNYVLGIDLGVLSLGWAVVEYAGDKPVGILKTGARIWEYSDASTLTVQKGQETPPGQERRQARQQRRQIFRRAQRLRRTCSVLQAMGLLDPGRRNSRARKQLWETVDQQAKEWLKSNIPGLADDPQLDHKFVYHLRAAALDHPLPKILLARVFFHLAQRRGFQSNRRVVSRSEEEGEVKKAISLLEHEISESGCRTLGEYFATLDPYTTRIRGRWTSRKMYQDEFERIWSAQIAINPGILDLSQKSRLFKAIFYQRPLKSQKRLVGRCSLEVIVRRGPDGPREVRPRQAALASLEAQRIRYMQRINDLEFTDPEGERRTPTQLEREQLYQLAETVEEISFSQIRKALGIPTGKKGAEWECNLERGGETKIPGNKTAARLRKILGNKTWDGFSESDQKKLVDTILAYLSPEALQSHLENVWKFDSDTARQLSNIELEQGYHSFSRRAIRKLLPLMHQGKRLNEAIKAVYGHTGRLRSVQERLPPVWKVMPELRNPLLVRALTELRKVINNLIRKFGKPQYIRIELGRELKLGKKRRQELAKEMRKREAERERAAKVIEETLHRKARPNEILKYLLADECDWECPYTGKKISVLTLLGDQPQFDVEHIWPFDRTLDDSFGNKTLCYHEENRQVKGNKTPFEAYSDSPDRWREILERVKRFKGPFAKEKLRRFLAADIPQDFPMRHLSDTRWITTAAADYLGYLYGGRIDSEGRQRVFTVTGPLTALIRRGWNLDGILGGPEKNRFDYRQHAIDAIVIALIDQAIVQQISLLSSRLWGTDRPTAVQLPEPWPSFYHDAKNAILNIVVSHRISRRLSGALHEQTHYAPPDNNGRTKIRKPLAALSAKEVENIVDDTIRKYVQHALANAEKKSPKEFFGNPENLPVLKGKNNHVAVVKSVRVWVSAKPVAVGNGDRVRYVKPGNNHHIEIYAIVDEHGNPVKYDGRCVTLLEAVQRKRRGEPVVCRNHGPNTRFLFSLSKNECIEWTNENGEKELLRVVGIADNDIEFRLLYDARPSNLVREAKDRIRGGYSKLFERRARKVLVTPLGEVLPAHD

SEQ ID NO: 489 - protein, 1059 aa, unidentified
  REGION 1..1059: note = Description of Unknown:uncultivated organism with predicted taxonomy: Planctomycetesbacterium
  REGION 1..1059: note = MG4-70 effector
MALVLGLDLGARSVGWALLEKQGDNWTRIVRAGVRVFEAGTEGNIEQGRDQSRGATRRIARLARRQIRRRRQRARALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRELKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGEKNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHRVTGALHKETFYTKLGQNQKGGDMVRLRVPVTSLSSKDIENIADPTVREIVRAKLEEVGGDAAKLEKNWPLLPNRNGNPVPIKKVRVNLNRAVVSVGKGRWQRWAEPSETHHIEIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 490 - protein, 1127 aa, unidentified
  REGION 1..1127: note = Description of Unknown:uncultivated organism
  REGION 1..1127: note = MG4-71 effector
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLDRQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVIRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIALTSARVVKMLADAARNPEQHRRRRFAPVPPPWPNFKDEVSAAAEKIIVSHRVDRRVAGPLHAETNYSPPIVHENREYRHRRVPLSSITRSQIAQIVDDVIRQLVEQKVGSAGDPAKVFSDPRNLPVLRSRDGTRCIPIKKVRVREHVAATTVGAGPRQRHVVSGKDTLHHTVIVARQTPSGEVWEDNPVDRLEVHRRLRNGQPVIQTDWGSDARYVFHLCKNDCIEMDVESGNPSAGRQIYVVRSISKRDIAVRLHYDARTLEQIVRAKERGKFRISSADLLRRRNARKVMVSPLGEVLPCRE

SEQ ID NO: 491 - protein, 1069 aa, unidentified
  REGION 1..1069: note = Description of Unknown:uncultivated organism with predicted taxonomy: Acidobacteria
  REGION 1..1069: note = MG4-72 effector
VSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPWPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 492 - protein, 824 aa, unidentified
  REGION 1..824: note = Description of Unknown:uncultivated organism
  REGION 1..824: note = MG4-73 effector
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLDRQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVMRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIA

SEQ ID NO: 493 - protein, 1069 aa, unidentified
  REGION 1..1069: note = Description of Unknown:uncultivated organism with predicted taxonomy: Acidobacteria
  REGION 1..1069: note = MG4-74 effector
VSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPCPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 494 - protein, 1059 aa, unidentified
  REGION 1..1059: note = Description of Unknown:uncultivated organism with predicted taxonomy: Proteobacteria
  REGION 1..1059: note = MG4-76 effector
MALVLGLDLGARSVGWALLEKQGDNWTRIVRAGVRVFEAGTEGNIEQGRDQSRGATRRIARLARRQIRRRRQRSRALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRELKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGEKNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHRVTGALHKETFYTKLGQNQKGGDMVRLRVPVTSLSSKDIENIADPTVREIVRAKLEEVGGDAAKLEKNWPLLPNRNGNPVPIKKVRVNLNRAVVSVGKGRWQRWAEPSETHHIEIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 495 - protein, 1057 aa, unidentified
  REGION 1..1057: note = Description of Unknown:uncultivated organism
  REGION 1..1057: note = MG4-77 effector
MALVLGLDIGARSVGWALLEKQGDEWKRIVRAGVRVFEAGTEGDIESGRDHSRGATRRIKRLARRQIRRRRQRARALYCALAEAGLLPEISPQPGSPMSLLIQQQINRLDGQFRIKYAAHPAVQQLPYLLRARALDQPLELFELGRVIYHLGQRRGFKSNRKAESRKAGAGDHSRAKEEKGKVYEGIDALRTLIDQAGARTLGEYFSRIDPAKQRIRGRYTHRSMYEQEFDAIWAAQKPHHPALTQELKDRLWNILFQQRPLQDKEEFVGECSWFPGEKRAPVWSLEFQRYRIWATLNHLRITGNRSAPRPLSPEERALLFTSLDAAEKLTIAQAKKALGLRRTAGFTLEEGGENHLPGNKVGAKFHAILGNRWTSLPPEKQNELVTVVARASTDEELEEALQRDWGLDGEMSRRIVREIVLPSGYALLSLRAIREVMPFLQQGYSVQEARQKAGIPLERQVPVHPLLPPLADSGVAVFNPAVKRTLTELRKVVNAIIRHYGKPDEIHIETARELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHLNDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELRQVLRSMNISFRPDHRVTGALHKETLYKYVGRNERDGDVVRVRVPVHTLSVRELGQIVDPNVRVIVQAKLAEIGGDLKKLENNWPCLPNRNGAPVPIRTVRVDLNRAVVTVGTGFRQRWAEPSETHHIEIYEISENGRTVWTGDVVSMREAILRAARGEPVVRRSAGANGRFLFSLAKEDTIRLFGDRAGIWVVKKIKGNEQIILVPQHDARKEGSGAASRTEFAPTAGGLRRYSAEKVTTLPIGDVVPCHE

SEQ ID NO: 496 - protein, 1031 aa, unidentified
  REGION 1..1031: note = Description of Unknown:uncultivated organism
  REGION 1..1031: note = MG4-78 effector
MLIPNDSLVLGLDIGSSSVGWSLIQNRGEAVEIVASGVRVFPWTVDEQTLMSRSVERRRARQRRRQLERRARRRRLVASLLQRQGFLPPGPPDHRDPSWKAVLAMDPYELRGRALETRLEPWEFGRVMYHLAHRRGFAGSGRGADDSETGVIQEQIEKTAREMQKVNARTLGEFLAQLDPRERRRRGWHTAREWYRTEFEAIVQAQQRMGLNLDPDWVKRLRRAIFFQRPLRTSPRAVGRCGLVPGRLRAAWGLLEAQRFRYLQKLNDLRVLLPDGQVRPLTPQERELVRGELERSERLTFDRLRRLLSSCDPSEALGEPSTGKAGNCDEDPGARSTSDFSRQKAGLAFNLECGGQDCLPGNTTAARIRSAIGQKWDQASEDVRRAMVELLLGVKDRKLRARLALRRKEWALSDLEAERLAQVNLEPGRCRFSSAALRRLVPHLEAGCALTEAIAREFPEHEARFRTEADPPPETPVTNPLVRRALAETRRVVNAIVRTWGLPGRIHIELARELRKPLRRLRELLRRNEERQRQRKHAIKYLIEKGIQDPRPDQIEKFLLWVECKQICPYTGQSISDVDLFGPLPRFDVEHIIPWSRCLDDSFANKTLCEVDHNRNRKRNRMPTEVYSQDELSQILRRVRAFQGPYRFEKLRRFQMTEADLTTETGWLLRGDQLQATAHAARLAGRLLGRWYPAEERLSRIQITNGAVTSWLRVAWGLNQLLGVADEKNRSDHRHHLVDATVIALTTAATVKALTEAARRSARPRRFVDMPVPPGLVDSLRQQLETVIVSHRVDRRVQGPLHEETFYGRIQTPPTGESRTVVRKRIDALSATEAQRIVDPRVRELVAQVCNGRAPKEVFRDPSLIPEVPFGSRKVRIRHVRIWVSENPISLKDGDPRLVLPGSNHHLEIFDCREGPRPGWRCVVVSRWEAMRRLRAGKPVVRRFDEHGCPLVCSLARGETVRLNLPGGPVIAVVQKLSQDDYNFRLHTDGRRAADIPASERIRIRSSKALKKCLGCKLVVDVLGRCHVSRD

SEQ ID NO: 497 - protein, 1031 aa, unidentified; identical to SEQ ID NO: 496
  REGION 1..1031: note = Description of Unknown:uncultivated organism
  REGION 1..1031: note = MG4-79 effector

SEQ ID NO: 498 - protein, 1063 aa, unidentified
  REGION 1..1063: note = Description of Unknown:uncultivated organism with predicted taxonomy: Planctomycetes
  REGION 1..1063: note = MG4-80 effector
MLAGKTHPSGSRTAASEYLLGLDIGTTSIGWALIALKNEEPCGILRAGVRCFEAGVEGDIEEGKDSSRAKPRRIARLARRQIWRRAARARKVFRVLQELDLLPPGEARSPHARHALLHALDQKLLQKYDLARDHVKAHLLPYLLRAWAVKRRLERYELGRALYHLAQRRGYQTNRRAEADNDDEDNEKQRKIVQGSIETLQQDLAGRTLGQFLATLDPCQRRIRQRWTSRSMYQDELARIWQRQAAALGLTEEDRKQLYKAIFFQRPLRSARGLIGQCDLETGQRRAPLASLVAQEFRILQQVNHLRVRLPDHTERPLTDQERATLSQILMHQEELSCAEARKLLGLTKHGTKFTIELAREKSLRGNRTQARLVAVLGPRWDTFTPQERNELIWDVIHYEKAAALARRAQKRWGLDPQTAEKLANVRLETGYAAHSAAALEKLNERMRAGEAYATAKQAVYPHAHQPDRVVSRLPPVKEALGELRNPAVLRALTELRKVVNAILRRYGKPKAIHLELARDLRRSRKEREKISAEQAKREKARRDALQKMLREFPNYQPKRGYDPAIEKILLAEECDWECPFTGKKINMQTLLGKSPQFDVAHIYPRRYLDDSFANKTLCYHEENRHRMLDRLPMEAYAGNPQRWQEILARVKRFQGPYAAEKLRRFQTEKVPDDFVSRQLNDTRHSTKLAAQYLGLLYGGPYDAQGHRRLVAVSGSITAHLRRAWRLGVHPGPDQAGPGKNRDDHRHHALDAIVVALTSHATIQKLSTFAARSQPGQQRLITGDLQEPWPSFQRDVRQALMAIYVSFRAEHKLAGPLHAETNYSPPIPTPDGKFVHHVRKSLSKLTETEIRGDAIVDPVIRALVQKKFEELGGKQPEKVFADPANHPYLTARDGRRIPIHKVRIRARANPVRIADDPARQRWVAPSGNHHAVIVAQLDPQGRESRWEDHVVTRLEAHQRLRQAGPRPRNQLIQRDWGPGKRFKFSLMLNDMLELDAPGGGRQVCRVLGISKGDYELCLHYDARSQTEIARQKQRIRVNAEKLRLLRARKVVVTPLGDIQPAGG

SEQ ID NO: 499 - protein, 806 aa, unidentified
  REGION 1..806: note = Description of Unknown:uncultivated organism with predicted taxonomy:Rhodobacteraceae
  REGION 1..806: note = MG4-81 effector
MALVLGLDIGARSVGWALLEKQGDEWKRIVRAGVRVFEAGTEGDIESGRDKSRGATRRIKRLARRQIRRRRQRARALYRALAEAGLLPGISPQPGSPMSLLIQQQINALDAQFRARYAAETGVHQLPYLLRARALDHPLEPFELGRVIYHLGQRRGFRSNRKAESRKAGAGDESKANEDRGKVYEGIDSLRTAMQQAGARTLGEYFSRLNPAEKRIRGRYTHRSMYEQEFDAIWTAQKAHHPALTREFKDRISDILFRQRPLQDKEEFVGECSWLPGEKRAPVWSLEFQRYRIWATLNHLRITGNRSAPRPLSPEERALLFTSLDAAEKLTIAQAKKALGLRRTAGFTLEEGGENHLPGNKVGAKFHAILGNRWTSLPPEKQNELVTVVARASTDEELEEALQRDWGLDGEMSRRIVREIVLPSGYALLSLRAIREVMPFLQQGYSVQEARQKAGIPLERQVPVHPLLPPLADSGVAVFNPAVKRTLTELRKVVNAIIRHYGKPDEIHIETARELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHLNDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELR

SEQ ID NO: 500 - protein, 1081 aa, unidentified
  REGION 1..1081: note = Description of Unknown:uncultivated organism
  REGION 1..1081: note = MG4-82 effector
MESKRLKQPFVLGIDLGVQSLGWAMLSLDDDDNPTGVVRLGVRCFDSGVGSEEEVAQGKEQSQNVERRGARLLRRQTWRRARRIAKVFHALQRFGLLPAEPAPTPEQRDALIKQLDADLRAEFLPAGDRAAFHLLPYRLRALGLDQPLPPFAFGRALLHIAQRRGFLSNRKAEGKENEKERSVVKESISFLQNELVRTGARTIGEYFAGIDPEEQRIRGRYTARQMYLDEFEKLWAVQAPHHQLDESAKKAIHQAVFFQRPLKSQSGLIGLCELEPGQRRAPAASLEAQRFRYLQKVNDLQIITPDGFILAPSEEQRRSLIDYLEHHAEITFDKLRTLWGLKLPRKSKKKSPAASGSDGDSDLASDAAQSDERPGYNFNLERGGEKKLKGNVTRARIEAALGCDLDELPAHVREPLVADVLEYENADALQRRLVQRYGLAEEQAAALAETHFEDGYASLSLAALRKFLPLMEQGMPFATARKELYKDSRQFQPHDILPPLFMVKAQLRNPAVSRGLNELRKVVNAVIRRYGKPKYIRIELARDLKQPRKVREERSKSMRKNEALRQQIIDDIRRFGIANPSETDILKVRLADECNWQCPYTGKAISMETLLGPHPQFDIEHIQPYSRSLDNSFTNKTLCDVHENRIAKRNLTPFEAYSGDEQRWHEIIARVRRFRGPASPAKLRKFLAKAIDSDFVERQLVDTRYMSRAAAEYVGLLYGGAVDSQGTRRVQVSPGGVTADLRRLWGLNRVLPRDPGDDERPGKKSRSDHRHHALDAAVIALTSPAMVQQLSRCAQDALLIGSRRFVALELPFPSLIDDLKKAIDEIVVSYRVKRKVRGRLHDQTYYSPPKPACDENGRTVEYRHVRKPLASISADRIEKIVDPVVRKTVQEHLARHGGDLKKAFGNPNNLPYLTAGDGRIIPIRRVRIRENISVLPIGKPPQLRFAAPGTNHHMEIVEVTDARGRVRWEGKLVNMFEAYQRRRQHLPVVCRDHGPNANFLFSLACGEYVEMEHVPGQRKVYRVTTISGERLEFRLHCDARPITVLKKLPKARINRSASTLLEAKARKVFVDPLGNVYPAGD

SEQ ID NO: 501 - protein, 1045 aa, unidentified
  REGION 1..1045: note = Description of Unknown:uncultivated organism
  REGION 1..1045: note = MG4-83 effector
MKTEYQKSGSVLGLDIGPTSVGWALIEENEQQPCRLIDMGVRIFEAGVEGDIESGRDESRAAKRRMARLHRRQLERASRRLKVLAEELQRRGLLPPGDVSTPDARKRFFDELDKLLAQGLDNPALLPFILRARALHERLDPHETGRALYHLAHKRGFLSNRKSQPKEDEELNTIAQAVGQLRQAMQETGAQTPGEHFAALLRNNGRVRGHHTFRNMNAQEFDLIWDTQRAFHPDVLSDEARKSIGKKIFFQRPLKSNKGLTGRCELEGARRAPLALLVSQRFRMLQKVNDLRLVSPDGLQRELTASERAELLRHLELQQNMKFTAIRKKLKLQGKFNFEIGGEESLPGNRTAARMASVFGQQRWQSMTPGEQDLAVQHVRSIRKPEALERAAADYWKLDPNAARAFAKISLEEGHVMLSQKAMSKLLPLMERGMPFATARKELYGAAPPPRAYDKLPPVHSPEMPAVTNPAVRRALTEMRKVVNAVTAKYGKPGLIRIELARDMKRPRKARQQISKRIRANKNKRDAARQQLLKEASGALGSAWEPKRSDIEKWLLRDECGGICPYTGKPISFHSLFVEPEFDIEHIIPFSRSLDNSFLNKTLCCATENRIKSKRTPWEAYGGTARWDEIIGRVRKFTGDANVAKLQRFQIRDADKEIDGFAARELNDTRYISRLAVQYAGLLYGAGADGVDPSGRRRVQAARGQITAHLRDVYELNSLLGDGGEKYRGDHRHHAVDALCVALTTPRAVKQLSDAAAAGEDRRRAWYDTRLITDPWPGFLDDARNAVNAIVVSHCPSRKVNSAMHDETVYSKPHADPMGRACVHVRKPLAALTDKMVDNIVDDRVREKVRQALNGRAPKDAFKDSASLPFFETRDHRRIPIKTARIRVYQSVNSLGRNAAARNVVPGSNHHVEIFAVEQEKGGVKWEGRMVTTIEAMARLHPKSRIPVVNRAHENGGKFLFSLSPGDTVRVTLDGEQKLLRLRTISKNNQGRLRLDAVCIREARKKAEIMQDKKWIIFPTLHALADMQFQKVTVTPLGEVFPCND

SEQ ID NO: 502 - protein, 1077 aa, unidentified
  REGION 1..1077: note = Description of Unknown:uncultivated organism
  REGION 1..1077: note = MG4-84 effector
MADPGLLKYVLGLDIGANSIGWALLTARGDERLTPTGIVQTGVRIFEAGVEGDLERGREESRGIQRRLARQARRRLDRTARRLAKVFGLLQDAGLLPRADTPASLPGVGVPREHMTARERRDERLRASAERDALLAQLDRELVAQCQDGLRAAGASQGEIWLVPHRLPYLLRARALDNKLPAHQLGRALYHLAQRRGFLSNRKAAPKKDEDQGVVDQGIQKIVAGMRETGARTLGEYFSRLDPTGERIRGRWTSRAMYQDEFDAIWAAQAPHHPEILTADLRKRLKRAIFYQRPLKVQKELIGECEFEKGRKRAPMALLVAQRFRLLQQVNNTRILTPDAVERGLTAEEAGKLIDALDTLGDITFKKAKRLLGLSQQHVFKFESGGEDKFIGNRTATKLIRVFGLDRWKTLKPSDRDRIVDDLLTIQKPETLARRAQRVWGLSPEAARELARTSLEDTHCRLSRLAIKNLLPLMETGMPYMTAARQVYGEKPAEPPRDSLPAVSEALPALRNPAVHRALTELRKVVNAIVRTYGKPAAIRIELARDLRKSPKQREQTWKKNRDNEALRKDAAEKLFREMGIQNPKRSDIEKMLLLQECGCMCPYTGKHISMRDLFGDAPQFDVEHIVPFSRSLDDSFLNKTLCEVAENRNVKGNRTPWEAYGHDLVRWNQILQRVSHFQGSAQREKLRRFQLQTIESPEQFASSQLNDTRYAAVEAMDFLKLLYGEEAQRKVIVQAARGGTTRFLREEFGLNQILGDGGEKSRDDHRHHAVDAICVALTDPATVKMLSDAAARALSEGRRRFASVPFPWGRFLDDVRASIQGINVSFRVSRKVGGALHEATFYSPPKKDPKTGQEHVHVRKPVTALSEQRVGNIVDPVVRAAVQAKLKEVGGDVRKLADNPPTLRAKDGREIPIRKVRLRESITPFGIGQGGARQVVTDTNHHVEIVQVPGKAGQPKWEGCVVSQYEALRRLRAKEPVVRRDHGNGRTFVFSLALGETVQMKGDDGQLALFKVAGVSQTGRGQIMLEFRRNADARPATVLRKIKGGRVFRTPDSLRSAMGTKVLLTPLGELRRVGRD

SEQ ID NO: 503 - protein, 1031 aa, unidentified; identical to SEQ ID NO: 496
  REGION 1..1031: note = Description of Unknown:uncultivated organism
  REGION 1..1031: note = MG4-85 effector

SEQ ID NO: 504 - protein, 1031 aa, unidentified; identical to SEQ ID NO: 496
  REGION 1..1031: note = Description of Unknown:uncultivated organism
  REGION 1..1031: note = MG4-86 effector

SEQ ID NO: 505 - protein, 1045 aa, unidentified
  REGION 1..1045: note = Description of Unknown:uncultivated organism
  REGION 1..1045: note = MG4-87 effector
MSSGYVMGIDIGVASIGWSVVEPGSEERPGRIVRLGTHLFEPGVDGTQTAIEQGKDEPKGAARRGARQVRRQLWRRAHRKRKLLFALMKHGIMPHATVPDGAAIDAYIKALDSRLRAAWCRAGDHQAHQIMPYLIRSAGVQRKITLEEFGRALYHLAQRRGFLSNRKAKKKKDEDTSQVKAEINELQSLIDRHVPATLGAYLASLNPDEQRLRDWWTARSMYLHEFEALWTEQSRHHRELTDEAKAAIHRAIFHQRPLKSQAHLIGRCSLEPGRKRAPLAHREFQYYRVLQGVNHLTIAPPGEAARKLDAAQRKVLTDALLAQGDLTIAKVRTLLKLPKGTDIAGERGEEEKKIVGHRTDAKLRDAIGPRFDAMSDRERDQLVLDLRSFRETEPLIGRLKSHWGLSDEQARKVADADLEEGYASYSLAAIRRLIPHLERGLSVSEARKAEYPESFRATQVHDLLPPVTDVMGDLRNPSVMRALTEARKVVNAIIRRYGKPEKIHVELARDLKHGRDRRAAITKQIRQREKQHADAKHRILAEIKGYEPTRIDREKVLLADECDWRCPYTGKKFGMKELIGEHPQVDVEHIWPFSRSFDNSFMNKTLCWHDENRRVKRGRTPYEAYSASPERYQEILGRVLAFKSDRRTVSEKFRRFTAEAIDEDFTNRHLSDTRYIARAVSEYLGVLYGGRTDADGKQRIVACSGGLTSWLRREWGLDALLSPTGDDAEAEKNRIDHRHHAVDALVVALTTPRTQAMLQAAAARQEQEGRFRLFGRIEPLWSAFPREAKAAVEAIVVSHRQQRAVSGKLHAESNYSKPIHGGHRIRKELHKLTRNEVSRIVDPRCRALVEAQLEKLGVDDPAKAFSKRENCPVIKGRDGVERRLRRVRLFSTASPTIVGQNARIRYVEPDSNHHCIVWAKRTKEGEEGPWEFEPVRLLDAYDRVCRGLPVVNRDGGSDRIFKFSVSINEFIEMDDPDSGGRQLYRIKKTSLREIGVQLHHDARTVDEVRKAGDLNKYRISPSALKSRNARKVFVNHLGEVSGAGG

SEQ ID NO: 506 - protein, 834 aa, unidentified
  REGION 1..834: note = Description of Unknown:uncultivated organism with predicted taxonomy: Planctomycetesbacterium
  REGION 1..834: note = MG4-88 effector
PREERIRQRWTSRPMYLNEFARIWSVQADAHGLTEEDRQRVFKAIFFQRPLKSQKGLIGRCELEPKHRRAALAMLVAQEFRILQKVIDLRVRFPDGTTRPLTADERQTLIDALQQVGEMTSASARKLLGLNKKGITFSIEEWGEKNLPGNRTNAKLAAIFGRRWLQFTPEERDQIVLEVLHYQKPAALVRRAMKHWGLDRQAAEKLSETRLEAGYARHSLAALTKLNASMRTGMPYMTAVKEAYPARFQAGKPMKLLPPVVKALRDLRNPAVCRALSELRKVVNAIVRLYGKPEKIRLELARDLRRSRKDRKRIAEQQREQETRRRKALERMMREFPNYQAKAGFDPAIEKILLAEECNWECPFTGRKIEMATLLGKNAQFDVAHLFPRRYLDDSFLNKTLCYHDENRHRMHDLLPKQAYGGDPQRWAEIIARVKAFKGSAATLKLERFLAAEVPEDFVESQLNDTRHNSKVAAEYLGLLYGGLWDASGKRRIEAITGGITALLRNAWRLRKDRADHRHHALDAIVLALVDPAQVKSLQESAERASEGSARFRLGELDEPWPGFRDAVRSALEEINVSIRADRKVGGALHAATNYSKPVRAANGSAVHHVRKPLHKLSVTEIEGDAIVDPVVRAAVQQRFADLGGKDPQKSFSDKANHPTLTAKDGRSIPIHKVRVRVREKAKMIAKGTVRQRFVTAGANSNHHCVIVAVLDAAGKETKWEEHIVDRLEANKRRASAPPGGMIQRDWGPARRFKFSLMPNDMLEMADESGTRQLYRVANISKGDYELRLHTDARESKELRSLKQRIRVHAEDLRRGRARKVTVTPLGEIQPAGD

SEQ ID NO: 507 - protein, 795 aa, unidentified
  REGION 1..795: note = Description of Unknown:uncultivated organism with predicted taxonomy:Planctomicrobium piriforme
  REGION 1..795: note = MG4-89 effector
MGFLMDASVSYGLGLDQGVASIGWAIVRLDAKGKAIGVERLGVHLFEAGTEGDIEGGRDESRAGPRRMARQARKQYRRRVLRKKRLLRWLQELGLMPAGDISTAEGRDKLLKDLDADLRTRWEADASIDHRLRQLLPYRLRAAGLTRRLEPFELGRALYHLAQRRGYLSNRKAQGASADPCAAGDATKPKKAGKGKKGTPAPPAEHAPAQPGASASPGEDQAGKGSGEAGGKEDPGVVRAAIVELERQMRGAGCTTLAEYFSKLDPTGTLGDRLRGRWTAREMFLEEFGRIMAEQAKHHPALTNEVQRKLHRAIFFQRPLQSMSHLIGTCDLVKGAKRCPLGHRLAQRFRLLQRVNDLDIRLPDFTRRPLTTEERGRLLAALDREGDIAFSTLKRKDWFGLPKGSTFNLEEGGEKKLVGNRTEAKCRCIFGDERWDAMSEADRDAVVHDLIVFEKPSALARRGESVWKLSPQRARALGDCVLEPGFAAHSKEALAVLVPCMEEGTPYAKAVQDKFKKVDATAEVRDRLPPVEKALGNLRNPTVTRALTELRKLVNAVVRKYGKPAWIRLELARDLKRARKQRERLSKEMREQEARRDSARAAIVRKAGLAGPSRSDIERYILAEECGFICPYTGKPMDRERLTDLVGRTPQFDVEHIWPLSRSLDDSYLNKTLCHVEENKAKGNRTPFEAYSQSPERWEQILDRVKRFGGTAARIKLERFTAKEIPDGFAERHLAETRKIGAASAGFLGLLYGGEIDAAHKRRVFVTTGGLTAHLRREWHLNGILGTEGEKARDD

SEQ ID NO: 508 - protein, 1097 aa, unidentified
  REGION 1..1097: note = Description of Unknown:uncultivated organism
  REGION 1..1097: note = MG4-90 effector
MSTPSNVPYVLGLDLGVASIGWAVLDTDAKGRPTSIRAAGSHLFEAGVGGGSQSTPEMAMARGKEESKAAPRREARAMRRQTMRRARRKKKLLGALIRHGLLPEGDIRTPAAIDAYVKALDAALRATWCPPGSSHVEYQNMAYRLRAEAAQRPLDAHAVGRALYHLAQRRGFESNRKTPKRDDEDTSDFQNKLDDLGDAIRSHTTQTLGAYLASLDPDEKRLRGRWTHRSMYEQEFETIWDAQAGALGLDGGAKQDIHHAIFYQRPLKDQSHLVGRCSLVPGKKRAPIAMRIAQDFRVLERVNHLRIVHDDHSERPLSKDERDNLLAALRREEKLTMHQAKKAAGLPTKHVKFSIEAGGETKLVGHRTDAKLCKIFGDRWDEMSEQEKDTVVEDVRCVRLPDTLRRIGEVRWGLSREKAQELADVQLEEGHSAHCLRALRKLVARMDADGLAYSTARKDEYPASFQSVEPMDLLPPVDAWEKDLRNPAVSRALTELRKLVNAIIDRHGKPVRIHLELARDLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHLQDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQRVRGPLHKDTIYSPKIDGKHRVRKELHKLTAKEVQSGKIVDTRALAAIQAKLAELAKTDPALADPAKAFKAPENAPLVPGPNGSKVRLRRVRIDTGDKPTRFGGAKGKGSARYAKNELNHHVAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGGWARARLRRSARAPFRSPRAAGHPRRRRTRGHHAIGRGRHRRGR

SEQ ID NO: 509 - protein, 930 aa, unidentified
  REGION 1..930: note = Description of Unknown:uncultivated organism with predicted taxonomy:Deltaproteobacteria bacterium
  REGION 1..930: note = MG4-91 effector
VSSQPRRQGYILGLDLGIASVGWACLEHDGQGKPTGILAAGTHVFEAAVENGQAADQTPAAKRRAVRSQRRLLWRRRQRRRKTARLLQQAGLLPVGPMDTSEELDKLIKDLDADLAKRWSGRVPPSRRDRLVYHIRAAAAQGPVEPDELGRAIYHLAQRRGFKSNRRTDRKADDKEIGKVKEGINELRRLMHEAGARTLGAYFATVDPHERRIRNRYTHRAMYEEEFEAIWSAQQPHHAVLTPELHDALHDALFFQRPIRKQPGLVGMCSLVQGKRRAPKALRAYQRFRMLQGVNHLRVDEPGRSARPLTAEERKKVIEALEREGDLTFAKLRQKKLLALPKEVEFDLAQAQFDRGEDKKGDRKIIGHRTDAKLRKVLGDRFDALTEEEKDQLVHELRSIPTEEGLIRRATRHWHFTMEQAEQLADLQLEDGYAALSLTAINRLLPHLEQGLSYAEARKREFPESFKSEDALDALPPVDKAIDNLNNPSVRRAMRELRMVVNALIREHGKPGRIHIELARELKHGRSRREQTERRMRERAKQREAAAETIIRETTARGFRIDKPRRDDIEKYLLAEECGWICPYTGRSIGWESLFGPHPEFDIEHIWPFSRSLDNRFLNKRLCHAATNRSVKKNRTPYEAFGQDTEQWEQILDRVRRFKGDPYARREKLRRFEAQEIDEGFLERHLRETSYFARLAQEYVGLLYGGIVDAEGTRRVIASSGGATHWLRRELGLDSILSDDEEKNRSDHRHHAVDAITTALLDSRTIQLLARAAQEAEERGSRRLFLSLQEEPWQGCRRDVEEAVARINVSHRQRRRVRGPLHEETNLSELINGGHRVRKALASLSPAEIKSDRIVDPRARELIRRALEEHAGGEITKKTITQVFSDENNLPLVPGPGGRLVRIRHVRVEVRDKPTLFGRDASRRWANTGS

SEQ ID NO: 510 - protein, 1062 aa, unidentified
  REGION 1..1062: note = Description of Unknown:uncultivated organism with predicted taxonomy:Alphaproteobacteria
  REGION 1..1062: note = MG4-92 effector
MTNGNLGKERFILGLDLGTNSIGWAMVGLDDNDKPCSVIRTGVHVFPAGTQGTDEDFAQGRDESRAQRRRMKRLLRRQIYRRKARARDAYKHLAEYGLLPKLEGYKGQNRDKAIKRLDVELLDRYLTAHPELIDEYELRDRVTAQTLVYRLRKEALDRQLQPDELGRILYHLSQRRGFKSNRKAPMKEDEKPGEVKAAIESLADEIKSAGARTLGEYFAGLDPEQRAIRRRKTDRSMYEQEFELIKKAQAPHHQRLDEKFWGRMRRILFYQRPLKSTKGLVGRCPLEPPRRRAPMASPAYQEFRLLQKLNDLCWIEVETGDSFALVDHPEHYETLYDALHKTDYLKFTEIAKLLKLKRNGKERTRFNLEAGGEKGLYGNRYASLMYQLFGENWQKEPSSCLSGIWQDLRSIQNETLLKRRAEEKWGLDASQIEILLQADIEEGYAAYSAKALQKLNQEMAQKIPFATALKSCYPEQAAEECVDLLPPYAEVGSDLRNPVVNRTLTELRKVVNAIVRRYGKPEKIRLEIVRDIKLGRKRRAEISKKMRTRQSEREDAKEQLRQWGVPVTHDAIERELLRRECNGVCPYTGREISPSQLFGESPQFDIEHIIPYSRSLDNSFANKTLCWHATNRNRKRGKTPYEVFSQDGDWEVILRRVAAFKGGYRDEKLRRFKLADLSEFDDFERRQLTDTAYAARLARDYLGVLYGAESLRRIQVLPGRLTSLLRGAWQLNRILGDPERNTKSRADHRHHAIDALVAAVTDRSMVQKICTRAKQLEDLKQVRLLPEIDPPWAGLLNDTREALARTIPSSRVDRKANGKLHEETIYGRILHKGEERTVLRRPLEALSSKEIDNIVDECIKDRVVQALEASGEKNPNKAFANPANLPRMVVRDRNGRSREVFIRRVRVFRSDNPVPVGRDRRLVKTGGNHHMELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 511 - protein, 1062 aa, unidentified
  REGION 1..1062: note = Description of Unknown:uncultivated organism with predicted taxonomy: Proteobacteria
  REGION 1..1062: note = MG4-93 effector
MTNGNLGKERFILGLDLGTNSIGWAMVGLDDNDKPCSVIRTGVHVFPAGTQGTDEDFAQGRDESRAQRRRMKRLLRRQIYRRKARARDAYKHLAEYGLLPKLEGYKGQNRDKAIKRLDVELLDRYLTAHPELIDEYELRDRVTAQTLVYRLRKEALDRPLQPDELGRILYHLSQRRGFKSNRKAPMKEDEKPGEVKAAIESLADEIKSAGARTLGEYFAGLDPEQRAIRRRKTDRSMYEQEFELIKKAQAPHHQRLDEKFWGRMRRILFYQRPLKSTKGLVGRCPLEPPRRRAPMASPAYQEFRLLQKLNDLCWIEVETGDSFALVDHPELYETLYDALHKTDYLKFTEIAKLLKLKRNGKERTRFNLEAGGEKGLYGNRYASLMYQLFGENWQKEPSSCLSGIWQDLRSIQNETLLKRRAEEKWGLDASQIEILLQTDIEEGYAAYSAKALQKLNQEMAQKIPFATALKSCYPEQAAEECVDLLPPYAEVGSDLRNPVVNRTLTELRKVVNAIVRRYGKPEKIRLEIVRDIKLGRKRRAEISKKMRTRQSEREDAKEQLRQWGVPVTRDAIERELLRRECNGVCPYTGREISPSHLFGESPQFDIEHIIPYSRSLDNSFANKTLCWHATNRNRKRGKTPYEVFSQDGDWEVILRRVAAFKGGYRDEKLRRFKLADLSEFDDFERRQLTDTAYAARLARDYLGVLYGAESLRRIQVLPGRLTSLLRGAWQLNRILGDPERNTKSRADHRHHAIDALVAAVTDRSMVQKICTRAKQLEELKQARLLPEIDPPWAGLLNDTREALARTIPSSRADRKANGQLHEETIYGRILFKGEEKTVLRRPLEALSSKEIDNIVDECIKDRVVQALEASGEKNPNKAFANPANLPRMVVRDRNGRSREVFIRRVRVFRSDNPVPVGRDRRLVKTGGNHHMELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 512 - protein, 1039 aa, unidentified
  REGION 1..1039: note = Description of Unknown:uncultivated organism with predicted taxonomy:Planctomycetales bacterium 4484_113
  REGION 1..1039: note = MG4-94 effector
MEDSPALLGIDIGPNSIGWALLDSEGKAIDDMGARVFEAGLADIEQDGKGKSRNVERRDARCIRRRLERTGRRLSKLARILQDAGLLPPGDVLSDEKRHQLVKRLDAQMDSPYSLRAKALDEKLKPYELGRALYHLAQRRGFLSNRKSAPKDEKEEGVVKEGIGQLRRDIDEAGARTLGEYFAKLDPHQQRIRGRYTSRKMYEDEFKMIWQEQRQYYPDLLTDDLKKAIHSAIFYQRPLKSAKHLIGGCQLENGKRRAPWALLIAQRYRYLSVLNNLTIRLPDGSERELTADERSKLIDYLEKNAELKFTTARGKKLLALPRGTKFNLEEGGEKRMLGNATAAKLRKIFGDRWDSFSEEEQDQIVEDIRSIVKDEALVKRGITKWGLDEESARKLTEVQLPDGYCRFSRKALEKLVPLLEQGKRLQTAIRELYPEKWARGSQPLDSLPPLSQCEDPALSELRNPIVSRALTEIRRVVNGVIAKHGKPDVIRVELARDVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQLNDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRRVRGPLHEETFYGKPRKDESGKSYVHTRKPLSGISAKDVDSIVDPVIRRIVQQKLSELGESDPKKAFKDAANLPLDPQGRVVRRVRLKRNLEVFPIAKEEHRRRYVVLGNNHHMEIVGVGEPDEHGEHPKWEAHVVSMFEAYQRKKNKEPIVKRDWSDETEKDGKPRKFLFSLAGGDTIELQKEEGKRELFIVRTVPQMKQVRFVPINDARRLKDIGKVGFTAYPETLRKWHCRKVAVNPIGEVHYQND

SEQ ID NO: 513 - protein, 1072 aa, unidentified
  REGION 1..1072: note = Description of Unknown:uncultivated organism with predicted taxonomy: Planctomycetesbacterium
  REGION 1..1072: note = MG4-95 effector
MTNQEAEEKYILGLDLGSNSVGWTLLAARQGKPDTPLRPVGLVAAGTRVFDAGVEGDIEKGREKSRAVQRREARLARRGTDRRARRMHLVYSILERAGLLPSLDPPSNSSEGNSRGIREQESQLRHETLVTLDRELAEKWREKLRSEGADKDKLRQINHTIPYILRARALDEKLEPYEVGRAIYHLAQRRGFLSNRKSPLKKDEDLGKVKGDINKLQEKIEETGSRTLGEYFSKLDPEEERIRQRWTGRKMYEEEFGKIWAVQQKHHPNILTEDLKKQLIGSKRHPAIFYQRPLKSQKHLIGKCELEKDRRRAPMAILDFQRFRMIQMLNDTRVITPMGELREMTAEEREKLLAELDIKGDLTFAKAKKVLGLSREHHFNWEGGIEKRIIGNRTAAKLVEIFGIERWKGFSEEERNRIIEDVLSIQKEDTLFRRGINAWGLDEESAKKFSELQLKPDYARFSRRALKKLLPLMQQGIPYKTAEKQVYGDRLAADAHASLPAVADVLPELRNPIVNRTLNELRKVVNAVIRKYGKPALIRIELARDLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQLNDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRRVNGPLHEETNYSPIKKDENGRDCVHIRKPVESLDKKNLKDIVDPVVRERVREWMEQANEHRPYPVHKTKDGREIPIKKVRIRKYDKPMTIGRDHRSRNVLSGSNHHLDIFEVTDKKGRPKWEGRLVSAFEAMQLKRQGKSVYSRERKEGGKFLFSLSQGEIIELDEKDGNRGLYRVRILSQLNQRGIKYPRVSYVRINDARLKADILKAKEWNTKLLEPLRKLNCRKVTITPLGEVRRAND

SEQ ID NO: 514 - protein, 835 aa, unidentified
  REGION 1..835: note = Description of Unknown:uncultivated organism with predicted taxonomy:Planctomycetales bacterium 4484_113
  REGION 1..835: note = MG4-96 effector
MEDSPALLGIDIGPNSIGWALLDSEGKAIDDMGARVFEAGLADIEQDGKGKSRNVERRDARCIRRRLERTGRRLSKLARILQDAGLLPPGDVLSDEKRHQLVKRLDAQMDSPYSLRAKALDEKLKPYELGRALYHLAQRRGFLSNRKSAPKDEKEEGVVKEGIGQLRRDIDEAGARTLGEYFAKLDPHQQRIRGRYTSRKMYEDEFKMIWQEQRQYYPDLLTDDLKKAIHSAIFYQRPLKSAKHLIGGCQLENGKRRAPWALLIAQRYRYLSVLNNLTIRLPDGSERELTADERSKLIDYLEKNAELKFTTARGKKLLALPRGTKFNLEEGGEKRMLGNATAAKLRKIFGDRWDSFSEEEQDQIVEDIRSIVKDEALVKRGITKWGLDEESARKLTEVQLPDGYCRFSRKALEKLVPLLEQGKRLQTAIRELYPEKWARGSQPLDSLPPLSQCEDPALSELRNPIVSRALTEIRRVVNGVIAKHGKPDVIRVELARDVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQLNDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRRVRGPLHEETFYGKPRKDESGKSYVHTRKPLSGISAKDVDSIVDP

SEQ ID NO: 515 - protein, 889 aa, unidentified
  REGION 1..889: note = Description of Unknown:uncultivated organism with predicted taxonomy: Planctomycetesbacterium
  REGION 1..889: note = MG4-97 effector
MSTTRVLGLDIGTSSVGWALIEGRDPDHVRIIAAGVRVFPMGVDEATLESRNIQRRQARLRRRQIERRARRKTKARHILQSHGFLPPGDPSHADPAWASVLALDPYKVRAEGLHRRLQPYEFGRAIYHICQRRGFKSNRKRPLTKKEKGAVHEDIAGLKREMDAAHAETLGEYLNRLDPRQQRRRGRHTNREWYREEFRQLCERQRDFGLPLSPALQKELEETIFSQRKVWWKRGSIGRCSLEPGKQRAARALPVCQRFRMLQRVNDLQIILPDGTTRQLSDEEREKLLARLDWEENLSFKSIRKLLRLPAEARFNLEEGGETKLPGNSTAYRISRAIGKREWERCSPESKAQILEALMSIEDEDLFKRVALRKQWGLNEEQAERLSEVALEEGRLDLSTKAIRKLLPLMEKQRLSYAEAAWRVYGDRGPAQAYESVPPVEDLRNPTVQRSLAETRRIVNAVIRRYGKPDRIHIELARDLKAPKQIRLRRSRQMRRNEAERKSARKELIEQGLPEPTGRDIEKYRLWKECGKRCPYTGKMISFSDLFGPHPKFDIEHIIPWHRCLLDSFANKTLCEVQENRSRKGNRTPYEAYSGDPDRYEEIKQRVREFTGPFGKAKLRRFRCEDIQKLPESLPLYGGEQLNATAYAARYAARHLALLYPQEERRKRVQVSAGRTTAYLRRAWNLNRLIGLADEKNRADYRHHAVDAVVIALTTPKLTGELSKAAARSVRPGTFQGLTPPPGLTRQLEEILDQMVVSHRVDRRVNGQLHEETFYGRIDNDSVTVVRKPLADLTDRDVAHIVDKKVQRLVREKLSGGAPPSKVFANPANLPAFVSPSGRTMRIRHVRVRVDASPVRIGSGAKTRLVLTGGNHHLEVFRVVEDGREKWRG

SEQ ID NO: 516 - protein, 1034 aa, unidentified
  REGION 1..1034: note = Description of Unknown:uncultivated organism
  REGION 1..1034: note = MG4-98 effector
METAENNSVLLGLDIGPNSIGWSLLQPDNGTSPDVNLISGVHIFEGGLDDLETDGKGKSRNLDRRNARAVRRLLWRRAHRLQKLAVSLQGAGLLPDNSDLENPQQRNALFDKLDKEFKSPYQLRARSLDSKLEPYELGRALYHLGQRRGFLSNRKTPVKDEKELGVVKGGINDLSKKISEAGARTLGEYFANKVIPEGGRVRGHYTSRQMYEDEFELIWNKQKEYYPDLLNDEFKEKIHHHIFYQRPLKSQKHLIGECSLERGRRRAPWALLIAQRFRYLQRLNDLSYFDRDEMRERKIEGDQRKILIELFETKEKVSFGAIRKALKLRGIKFNLELGGEKNLPGNKTTARIIKAIGKTKWFSLSEREKEALVVDLRCIRKEETLKRRGIKAWGLDEEAAEKFGTIQLEDGYCNYSRQALQKLLPLLEKGVPLQTAIKELYPEQFENTGKPMDSLPPILESGLPELRNPVVMRSLTEIRKLVNAIIKRYGKPDIIRIELARELKQSPKQRQETTKRMRRNEKERNDIREQIRNETGIENPTYTDILKVRLAKECNWECPYTGTHISMQQLIGPHPQFDIEHIIPHYRSLDNSFTNLTLCEARENREVKRNRTPYEAYHDTAKWEDIIRRVERFDGPMRNAKLRRFLLQGEELEKFLDGFTNRQLNDTAWASKWAKKYLGLLYGDIKSKGIDSAGKLRVQAVSGRLTSELRRIWGLNNILGDGNTKSRDDHRHHAIDAIVIALSNPAVVKQLAEASKRAVNIGDKLLKDFPQPWEGFHNDVKRVIDGIIASHRVSKRVRGALHQGSNYGKPRKDKNGNQYVHIRKPIDGISKKEVENIVHPTTRKLVMDKLAELGESDPKKAFKEKDNHPRLMTKSGEFPIHRVTVRMNLSATFPVGKNYRTRYVISDRNHHIEIVEKPDGKWDGYVVSMFEAYQRKKNGEPIVKREFENDEKFLFSLANGEIIELDGPDNKSRALYVIRTIPQSKQLYFVPINDARKSGDIGRTGLTAIPNALKSRNCKKMLVTKLGEVRFAND

SEQ ID NO: 517 - protein, 1050 aa, unidentified
  REGION 1..1050: note = Description of Unknown:uncultivated organism with predicted taxonomy: Planctomycetesbacterium
  REGION 1..1050: note = MG4-99 effector
WTLLAARQGKPDTPLRPVGLVAAGTRVFDAGVEGDIEKGREKSRAVQRREARLARRGTDRRARRMHLVYSILERAGLLPSLDPPSNSSEGNSRGIREQESQLRHETLVTLDRELAEKWREKLRSEGADKDKLRQINHTIPYILRARALDEKLEPYEVGRAIYHLAQRRGFLSNRKSPLKKDEDLGKVKGDINKLQEKIEETGSRTLGEYFSKLDPEEERIRQRWTGRKMYEEEFGKIWAVQQKHHPNILTEDLKKQLIGSKRHPAIFYQRPLKSQKHLIGKCELEKDRRRAPMAILDFQRFRMIQMLNDTRVITPMGELREMTAEEREKLLAELDIKGDLTFAKAKKVLGLSREHHFNWEGGIEKRIIGNRTAAKLVEIFGIERWKGFSEEERNRIIEDVLSIQKEDTLFRRGINAWGLDEESAKKFSELQLKPDYARFSRRALKKLLPLMQQGIPYKTAEKQVYGDRLAADAHASLPAVADVLPELRNPIVNRTLNELRKVVNAVIRKYGKPALIRIELARDLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQLNDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRRVNGPLHEETNYSPIKKDENGRDCVHIRKPVESLDKKNLKDIVDPVVRERVREWMEQANEHRPYPVHKTKDGREIPIKKVRIRKYDKPMTIGRDHRSRNVLSGSNHHLDIFEVTDKKGRPKWEGRLVSAFEAMQLKRQGKSVYSRERKEGGKFLFSLSQGEIIELDEKDGNRGLYRVRILSQLNQRGIKYPRVSYVRINDARLKADILKAKEWNTKLLEPLRKLNCRKVTITPLGEVRRAND

SEQ ID NO: 518 - protein, 1050 aa, unidentified; identical to SEQ ID NO: 517
  REGION 1..1050: note = Description of Unknown:uncultivated organism with predicted taxonomy: Planctomycetesbacterium
  REGION 1..1050: note = MG4-100 effector

SEQ ID NO: 519 - protein, 1034 aa, unidentified; identical to SEQ ID NO: 516
  REGION 1..1034: note = Description of Unknown:uncultivated organism
  REGION 1..1034: note = MG4-101 effector

SEQ ID NO: 520 - protein, 1056 aa, unidentified
  REGION 1..1056: note = Description of Unknown:uncultivated organism
  REGION 1..1056: note = MG4-102 effector
VFKDDMILGIDIGSNSVGWALLGYDADSREVTGITDAGVRIFEAGMDGDISTGNATSRCAERRAKRLIRRNLDRRRRRMLKLQHILQRAGLLPEGDDIEKIILDLDAEVRKFCLAVPEGERPSREVLAHTYPYFLRALAINGKLPPHLLGRAVYHLAQRRGFWSNRKSLVDEKELGQVKQGISELRGKMEETGARTLGEYFAYRDPTRDRIRGLWTSRDMYRHEFDLIMNNHPHLVTPDLRKSIEKAIFFQRKLKSVKSLIGHCALEKNKRRCPWYRFEAQEFRILQTITNLKVIEPDGELRELSAEEWENLYRVMMGETGDLDRHGNIKISKAKKLLGLPKGSKFTIEDGGEKTLKGNKTLSSLLAVFGDSWNEFSPRDKEDILHDLRSFEKREPLVRKAMRKWNLEQEEAEAFADIKLPEDYCNLSYKALCKLLPLLREGWSYGSAVKEIYPEAFKSDGIVHELLPGLDTSSIDLRNPVVERSLTELRRVVNAVIRKYGKPGIIRLEMAREMKLSANRKKEIIKRNRDLEKQREKAAEKIRDVFPGMTPGRTDTTKVLLAEECGWRCPYTGRSISIRTLFGPHPQFDIEHIIPRSRSLDDSFLNKTLCYHEENRNVKRNRTPYEAYHGTPRYDEILDRVAKFNGRLAKEKLRRFRMTPEEVEDRFADFTQRQLNDTRYAAKEAAAYLGMLYGGSVTSIDGRKRVQVLSGGLTYKVRSAYNLNGILNDGDVKTRNDHRHHAVDAIAIGMTSPGMVKKLTEIAKELENRRDYIRFGTGKGILPDKWNTFDEDVRRVIGKIKVSHKIPRKVRGAFHEETFYSKEYEHKVNGKTGMYRHVRIPLENLEKNKIPKVVDKGVREAIIRKLDELGIDDPRRAFRNGENLPEIVSADGAKRIPIKKVKIIRKQNTIRVGEGRRARNVVPGNNHHMMIYAVLDKRGEVKKWDGEVVTLLEARRRLMNGEPLVNKVNTPTARYVMTVQRGDVFEMDIKGKRELVITRDVPQTKQMSFVRLNDARLKKEIKSSGEWFTKRPNSMRTSNVKKFTITPLGELRNSNA

SEQ ID NO: 521 - protein, 1056 aa, unidentified; identical to SEQ ID NO: 520
  REGION 1..1056: note = Description of Unknown:uncultivated organism
  REGION 1..1056: note = MG4-103 effector

SEQ ID NO: 522 - protein, 867 aa, unidentified
  REGION 1..867: note = Description of Unknown:uncultivated organism with predicted taxonomy: Planctomycetesbacterium
  REGION 1..867: note = MG4-104 effector
LYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTT

SEQ ID NO: 523 - protein, 1021 aa, unidentified
  REGION 1..1021: note = Description of Unknown:uncultivated organism
  REGION 1..1021: note = MG4-105 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPEFFLQIDRAFLAGLPEDEQKRAAHVVPYLLRAAALDRPLAPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWAKDGQEYLCVIRGISLPQFSCMPINDARDVKTLKAAGLWFTPTLSAAFRGKMEKFHTTPLGELRRAND

SEQ ID NO: 524 - protein, 1022 aa, unidentified
  REGION 1..1022: note = Description of Unknown:uncultivated organism
  REGION 1..1022: note = MG4-106 effector
MKQRVLGLDLGISSVGWAVIDDDNTNRIELIDWGSRIFEPGVDATEDEIRAGKGESRCSVRRQKRSLRRMYQRRRRHKEEVTAILMREGMLPEKLTPEFFVKVDRDFLLTLPENERKRAAHVVPYLLRSLALDRPLDRYQLGRALYQLAQRRGYKSNRKQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERKMLLWCLDGLSGHLNSKGRIALSKLGKLVGLDKGEKFTLGDDDKDICGNELNAILFRAFGDKAVELSEAERNIFLNTLNSVENNAVMRKILMEKWHFNEETAEELSHIVLPDDYCNYSRKAIENLLPDMEAGIALNTIIKLKYPEQYQPSDVVEPVLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNLNDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 525 - protein, 992 aa, unidentified
  REGION 1..992: note = Description of Unknown:uncultivated organism
  REGION 1..992: note = MG4-107 effector
IDWGSRIFEPGVDATEDEIRAGKGESRCSVRRQKRSLRRMYQRRRRHKEEVTAILMREGMLPEKLTPEFFVKVDRDFLLTLPENERKRAAHVVPYLLRSLALDRPLDRYQLGRALYQLAQRRGYKSNRKQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERKMLLWCLDGLSGHLNSKGRIALSKLGKLVGLDKGEKFTLGDDDKDICGNELNAILFRAFGDKAVELSEAERNIFLNTLNSVENNAVMRKILMEKWHFNEETAEELSHIVLPDDYCNYSRKAIENLLPDMEAGIALNTIIKLKYPEQYQPSDVVEPVLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNLNDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 526 - protein, 1021 aa, unidentified
  REGION 1..1021: note = Description of Unknown:uncultivated organism
  REGION 1..1021: note = MG4-108 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMNEEERQAFFHHLACMEKDDALRRILRTRWGLSEEAAEKAAHISLPDDYCGFSCKALKQLLPDLESGIALSTVIKLKYPEQFQASERVLAFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKALKAAGLWFTPTLSAAFRGKMEKFHTTPLGELRRAND

SEQ ID NO: 527 - protein, 883 aa, unidentified
  REGION 1..883: note = Description of Unknown:uncultivated organism with predicted taxonomy: Planctomycetesbacterium
  REGION 1..883: note = MG4-109 effector
MQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 528 - protein, 1021 aa, unidentified
  REGION 1..1021: note = Description of Unknown:uncultivated organism
  REGION 1..1021: note = MG4-110 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGSSRKALKQLLPDLESGIALSTVIKLKYPEQFQASERVLEFLPPLDETGLQLRNPVVHRTLTEMRQVVNAVIRKYGKPDLIRLELARDLKNSSKDRENIARRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKLQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 529 - protein, 879 aa, unidentified
  REGION 1..879: note = Description of Unknown:uncultivated organism with predicted taxonomy: Planctomycetesbacterium
  REGION 1..879: note = MG4-111 effector
KEEVTAILMREGMLPEKLTPEFFVKVDRDFLLTLPENERKRAAHVVPYLLRSLALDRPLDRYQLGRALYQLAQRRGYKSNRRQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERENALVVLDGLSGHLNSKGRIALSKLGKLVGLDKGEKFTLGDDDKDICGNELNAILFRAFGDKAVELSEAERNIFLNTLNSVENNAVMRKILMEKWHFSEETAEELSHIVLPDDYCNYSRKAIENLLPDMEAGIALNTIIKLKYPEQYQSSDVVEPDLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYAEIIERVRHFKGSFAKIKLEKFELETAEVQDFINRNLNDTRYASKLATEYLALLYGGRNDRNGVQRIQCSAGGCTAVVRRAWGGNYLLGEGEKVRGDHRHHAIDALTIAVTSPAIVKLIAGVKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTK

SEQ ID NO: 530 - protein, 1021 aa, unidentified; identical to SEQ ID NO: 526
  REGION 1..1021: note = Description of Unknown:uncultivated organism
  REGION 1..1021: note = MG4-112 effector

SEQ ID NO: 531 - protein, 992 aa, unidentified; identical to SEQ ID NO: 525
  REGION 1..992: note = Description of Unknown:uncultivated organism
  REGION 1..992: note = MG4-113 effector

SEQ ID NO: 532 - protein, 1021 aa, unidentified
  REGION 1..1021: note = Description of Unknown:uncultivated organism
  REGION 1..1021: note = MG4-114 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPEFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 533 - protein, 1015 aa, unidentified
  REGION 1..1015: note = Description of Unknown:uncultivated organism
  REGION 1..1015: note = MG4-115 effector
GLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMNEEERQAFFHHLACMEKDDALRRILRTRWGLSEEAAEKAAHISLPDDYCGFSCKALKQLLPDLESGIALSTVIKLKYPEQFQASERVLAFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKIRSIGEGDRKREVANGANLVLAIYARHDADGREIGWDGEVVTVLDARLRLQRNEPVFPKVKEGNPLKFTLRKGDVVRWSKDGQENLCVIRGISLPQFSCMPINDARDVKTLKAAGLWFTPTLSAAFRGKMEKFHTTPLGELRRAND

SEQ ID NO: 534 - protein, 1071 aa, unidentified
  REGION 1..1071: note = Description of Unknown:uncultivated organism
  REGION 1..1071: note = MG4-116 effector
MAHGLSEENDYILGIDLGSASLGWALVALSESGDPTGIIKLGVRIFEPAVSGDVEKGQDESNSVARRGARLIRRQRRRRAARQAALFRLLQKQNLLPGTTGVERDSSAQRHVILNELDSALSLKWRQRDSENGFVDLPIYHLRKAALYHALDPFELGRVFYHLSQRRGFRSNRKAERIEKKGEDQGAVKTAISELDEAIRAAGAQTIGEYFAGLDPHTQKVRRIWTGRSMYEEEFGKIWAIQSRFHPTLLTEELHREIWRLLFYQRPIKAQKNLIGECELEPGERRASWATLEAQRFRLLQKVNDLEIIYPGKLMGVALSADQRQHVYRLLDEHGDQTFKAIREHLGLDKNIGFNLERGGERSLKGNIVQRRMIEAFGPRWQALADEEKRQVVDDWRSIESPESLQRKLIAKWRLVPEAASRLAKSSPPSGYCMLSRKAIRRVLPLMFDGKRFMAARQEIPEYVPKLEAPLDRIPPVLDALRNLRNPAVERALTEVRKVVNALVGEYGKPSEVRIELARDLKKPRQERARATDLNRKRQRERDSVKERIVREGGLERPSRDDIEKVLLWEECGGICPYTGKSIAFASLFGEHPQFGVEHIIPFSRLPDNSFQNKTLCDHEQGRNVKRNKTPFEAYPNTEEYDAILTRIKAWETPNLGKQKRFELRTLEELEGFSTRQLNDTRYSSRLACDLIAKLYGGRVIETETGTRQVVFASSGMVTATLRKGLGLEAVLCEASGSSNGETRGKSRTDHRHHAIDALTIALTRQSMIQTMSRTASLEPNWAITSRSLRTIPSPWSNFIDSVRPHVQELLVSHRPEHRLTGALHDETNYSKPRKVNGKSVVHIRKPVNGLSANDIENIVDPVIRDAVRRKAIDLGGDLKRCNPNAGVDDWPQLVTKTGKHVPIKRVRISKSLEVETIATGNRTRYVATSSNHHLAIFAQIDSQGREKHWEPRIVSLYAAMDRKRKGLPVVQRFHPETGDFTFKFSLMGGDTVLLHKDCDHSKGICNASVWRLRTIASNGQLSLVRINDARLKADIQKAKEWWSPATDSLRKFSAIKVSIDSLGRLHGAND

SEQ ID NO: 535 - protein, 1062 aa, unidentified
  REGION 1..1062: note = Description of Unknown:uncultivated organism with predicted taxonomy:Acidobacteriales bacterium 59-55
  REGION 1..1062: note = MG4-117 effector
MSAALEQQKYVLGLDLGSASLGWALIALNDADDPVSLIRAGVRIFEPGVDGTSIEIEQGKDQSKAVERRTARLHRRQLRRRAARQRDLFRLLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKVAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEVAFLFSLMKDDTVELEKDGTRGIYRVKKFEATGKITFVPVNNAMLDKMQYTTGAAWSRMPATLKPMSPRKIVIDLLGKVHPAND

SEQ ID NO: 536 - protein, 1071 aa, unidentified; identical to SEQ ID NO: 534
  REGION 1..1071: note = Description of Unknown:uncultivated organism
  REGION 1..1071: note = MG4-118 effector

SEQ ID NO: 537 - protein, 1062 aa, unidentified
  REGION 1..1062: note = Description of Unknown:uncultivated organism
  REGION 1..1062: note = MG4-119 effector
MSSALEQQKYVLGLDLGSASLGWALIALNDADDPVSLIRAGVRIFEPGVDGTSIEIEQGKDQSKAVERRTARLHRRQLRRRAARQRDLFRLLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKVAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEVAFLFSLMKDDTVELEKDGTRGIYRVKKFEATGKITFVPVNNAMLDKMQYTTGAAWSRMPATLKPMSPRKIVIDLLGKVHPAND

SEQ ID NO: 538 - protein, 1071 aa, unidentified; identical to SEQ ID NO: 534
  REGION 1..1071: note = Description of Unknown:uncultivated organism
  REGION 1..1071: note = MG4-120 effector

SEQ ID NO: 539 - protein, 972 aa, unidentified
  REGION 1..972: note = Description of Unknown:uncultivated organism with predicted taxonomy:Acidobacteriales bacterium 59-55
  REGION 1..972: note = MG4-121 effector
LLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMSRFAIQTEEALGDFSARQMNDTRYASVLASRFLGALYGGRDLVDAEKVRQVIFASSGAVTATLRSSWGLEAILREIVPTEPGEPRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRNGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 540 - protein, 853 aa, unidentified
  REGION 1..853: note = Description of Unknown:uncultivated organism with predicted taxonomy: unculturedbacterium
  REGION 1..853: note = MG4-122 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPGTLDGSPEEQRHSILNELDQALARKWQSAFPDNRFAQLPLYYLRKRALDEPLEAYEIGRILFHLIQRRGFLSNRRENKQNPDQKKELGQVKAEIHSLEQEIQNAGARTLGEFFAGLDPHAQKVRRRWTARKMFQDEFEKIWETQVIHCPNLLTPELHDKIAHLLFFQRPIAAQSHLVGKCELESGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFADRWDTMSAGKQHQIVENWRNSESDEALIREAEEQWSLDDTAATLLSEQIPEPGYCAVSLTAISKLLPLMQCGKSFKEAETEVYGARFSGGVVFDTLPEVRKQLESLRNPAVERALTELRKVVNAIVREYGKPYEIRIELARELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHKMSGELHKGTNYSAPYNYKGKPTVHTRCLLSALS

SEQ ID NO: 541 - protein, 1071 aa, unidentified; identical to SEQ ID NO: 534
  REGION 1..1071: note = Description of Unknown:uncultivated organism
  REGION 1..1071: note = MG4-123 effector

SEQ ID NO: 542 - protein, 1071 aa, unidentified; identical to SEQ ID NO: 534
  REGION 1..1071: note = Description of Unknown:uncultivated organism
  REGION 1..1071: note = MG4-124 effector

SEQ ID NO: 543 - protein, 1071 aa, unidentified; identical to SEQ ID NO: 534
  REGION 1..1071: note = Description of Unknown:uncultivated organism
  REGION 1..1071: note = MG4-125 effector

SEQ ID NO: 544 - protein, 1079 aa, unidentified
  REGION 1..1079: note = Description of Unknown:uncultivated organism
  REGION 1..1079: note = MG4-126 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLRSIAANGQLSLVRINDARPKSEIIKAKEWWSPIEDTLRELDAVKVVIDSLGRIHQAGG

SEQ ID NO: 545 - protein, 1076 aa, unidentified
  REGION 1..1076: note = Description of Unknown:uncultivated organism
  REGION 1..1076: note = MG4-127 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPGTLDGSPEEQRHSILNELDQALARKWQSAFPDNRFAQLPLYYLRKRALDEPLEAYEIGRILFHLIQRRGFLSNRRENKQNPDQKKELGQVKAEIHSLEQEIQNAGARTLGEFFAGLDPHAQKVRRRWTARKMFQDEFEKIWETQVIHCPNLLTPELHDKIAHLLFFQRPIAAQSHLVGKCELESGKQRAPWAAMEAQRFRILQKVNDLRLVNPGSLISDPLTEEDRQRLYSLLDREGDQTFKAIKKYLSFPTDVQFNLEKGDEKRLRGNRTQAAMRKVFADRWDTMSAGKQHQIVENWRNSESDEALIREAEEQWSLDDTAATLLSEQIPEPGYCAVSLTAISKLLPLMQCGKSFKEAETEVYGARFSGGVVFDTLPEVRKQLESLRNPAVERALTELRKVVNAIVREYGKPYEIRIELARELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHKMSGELHKGTNYSAPYNYKGKPTVHTRCLLSALSAAKIADDEVIIDTAVRDAVRKKLAELGGNPKLFDRPENAPCLCARDGRLIPIRKVRIRETKNPVKVGKGVRERFTSSGGIHHVALFVTRDEKRREKWDSEVAQVTEIYRRCPRNDRRKSRSQPVVIESPISRQLKSDPEAQFLFSVMKDDTIEVTDPNGIYILRVKKFSDNKQMWFVPVNDAHDDTQQMKLGITWSKTPNSLKELRPRKVVVDLLGKVHPAND

SEQ ID NO: 546 - protein, 1062 aa, unidentified
  REGION 1..1062: note = Description of Unknown:uncultivated organism with predicted taxonomy:Acidobacteriales bacterium 59-55
  REGION 1..1062: note = MG4-128 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 547 - protein, 973 aa, unidentified
  REGION 1..973: note = Description of Unknown:uncultivated organism
  REGION 1..973: note = MG4-129 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRD

SEQ ID NO: 548 - protein, 951 aa, unidentified
  REGION 1..951: note = Description of Unknown:uncultivated organism with predicted taxonomy: Planctomycetes
  REGION 1..951: note = MG4-130 effector
MAAAKKPYILGLDLGVQSAGWAMIDVDDHGRPCGIRRSGVRCFDSGVGSETEIASGKDESQNIKRRQMRLQRRQLWRRGRRLKKVFLVLQKAGILPPGETRSPEQRHELLKLLDAELAKTHLPEHDRVAGHLLPYRLRALALDQALPPFAFGRALFHLAQRRGFLSNRKSASKDGDDEGAVKAGIAELQQNMQEAGVRTLGEYFSKLDPEAEKQRIRKRWTARSMYLDEFEKIWVAQSPHHPMLGEEWKTRVYDAIFHQRPLKSQKGLVGVCELEPTCRRAPRASVEAQRFRYLQKVNDLEIVTPDGEIWALTDPEHVDLRKKLIELLDTQAEVKFASLRSKLGLWAKLGRKKPKGTDKDFTFNLEAGGESKLKGNTTATKIRGVLGDDYGKLSPEQLAGLVDDLLEYEKKEALARRLTKNYEIAPAKADQLADVTLEPNYASLSREAMHKLLPIMENGRRFASLTQEELEKLFPNRRKGGITYDLLPPVLGIIDLRNPVVCRGLTELRKVLNALIRQYGKPELIRVELARDLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARMLQDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRRVTGALHEETNYSKPHKSRDGNGNGKEVEYRHVRKPLQNMSANEVENIVDDIIRKLVQTKLDQIGGEPKKVFADPGNHPYLTAKDGRRIFIHKARIRKTVAVIPLGKSSSPRYAAPGSNHHMELFATL

SEQ ID NO: 549 - protein, 1062 aa, unidentified
  REGION 1..1062: note = Description of Unknown:uncultivated organism
  REGION 1..1062: note = MG4-131 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 550 - protein, 835 aa, unidentified
  REGION 1..835: note = Description of Unknown:uncultivated organism with predicted taxonomy: Planctomycetesbacterium
  REGION 1..835: note = MG4-132 effector
MSVSAGSEHPYVLGLDLGSASLGWALIGIDAIETPVSLIRAGVRIFEPGVDGSALDIQQGKDQSKAVDRREARLHRRQLRRRVARQRELFGVLQGAGLLPTCDVPGAGIGSEQRHRILNALDMALTVRYRTGADKATFDQMPLYVLRKKALYEPLAFDELGRVFFHLSQRRGFQSNRKDVKKKTKEDEDQGQVKSAIYELEQAIQASDAQTLGEYLAGLDPHEQKVRRQWTGRRMFKEEFERIWVAQQAYHPSLLTPELHDRVWGLLFDQRPVSAQKHLVGKCELEPDKRRSPWAALPAQQFRVLQKVNDLRLLQENGKETPLYPQQRAAVFDLLENHGTQSFVKIKQHLGLPKTAQFNLERGKAKELKGNVTAQSMRKVFGVRWEEFSEGKQNQIIENWRNCEKDEDLKREAIEHWGLDEASANVLLAEKAPADYCALSLTALSKILPLMRAGKSFKEAETEVYDNRFSGAAVHPFIPVLRPHRKHFHNSTPPPQDPLMASIANGLRNPAVERAITEMRKVVNAIVREHGRPYEIRIELARELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQLNDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQ

SEQ ID NO: 551 - protein, 785 aa, unidentified
  REGION 1..785: note = Description of Unknown:uncultivated organism
  REGION 1..785: note = MG4-133 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNA

SEQ ID NO: 552 - protein, 1062 aa, unidentified
  REGION 1..1062: note = Description of Unknown:uncultivated organism with predicted taxonomy:Acidobacteriales bacterium 59-55
  REGION 1..1062: note = MG4-134 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 553 - protein, 1062 aa, unidentified; identical to SEQ ID NO: 549
  REGION 1..1062: note = Description of Unknown:uncultivated organism with predicted taxonomy:Acidobacteriales bacterium 59-55
  REGION 1..1062: note = MG4-135 effector

SEQ ID NO: 554 - protein, 1062 aa, unidentified; identical to SEQ ID NO: 549
  REGION 1..1062: note = Description of Unknown:uncultivated organism with predicted taxonomy:Acidobacteriales bacterium 59-55
  REGION 1..1062: note = MG4-136 effector

SEQ ID NO: 555 - protein, 1105 aa, unidentified
  REGION 1..1105: note = Description of Unknown:uncultivated organism with predicted taxonomy:Acidobacteriales bacterium 59-55
  REGION 1..1105: note = MG4-137 effector
MSVSAGSEHPYVLGLDLGSASLGWALIGIDAIETPVSLIRAGVRIFEPGVDGSALDIQQGKDQSKAVDRREARLHRRQLRRRVARQRELFGVLQGAGLLPTCDVPGAGIGSEQRHRILNALDMALTVRYRTGADKATFDQMPLYVLRKKALYEPLAFDELGRVFFHLSQRRGFQSNRKDVKKKTKEDEDQGQVKSAIYELEQAIQASDAQTLGEYLAGLDPHEQKVRRQWTGRRMFKEEFERIWVAQQAYHPSLLTPELHDRVWGLLFDQRPVSAQKHLVGKCELEPDKRRSPWAALPAQQFRVLQKVNDLRLLQENGKETPLYPQQRAAVFDLLENHGTQSFVKIKQHLGLPKTAQFNLERGKAKELKGNVTAQSMRKVFGVRWEEFSEGKQNQIIENWRNSEKDEDLKREAIEHWGLDEASANVLLAEKAPADYCALSLTALSKILPLMRAGKSFKEAETEVYDNRFSGAAVHPFIPVLRPHRKHFHNSTPPPQDPLMASIANGLRNPAVERAITEMRKVVNAIVREHGRPYEIRIELARELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQLNDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQQVAEVLTSHRPEHKVGGELHRGSNYGRPYMYNGASTIHTRKLISALKIEDIDADDVIVDRVIRDILRAKLAELGGNPKAFEKPENTPYMTTPAGKRIPIRKVRIRETRNPLRVGEGPRERYVASGGIQHVELFVARDEKRREHWLSHVVQTTEMYDLFPKRDHRPGRPKAVTKSIPIRRQMPGQPEAEFLFSLLKNDTIELEKAGCREIFRVKKFEATGKITFVPINNAMPDTLQYGTGSAWSKMPTTLKVMSPQKVVIDLLGRVHPAND

SEQ ID NO: 556 - protein, 1001 aa, unidentified
  REGION 1..1001: note = Description of Unknown:uncultivated organism with predicted taxonomy: unculturedbacterium
  REGION 1..1001: note = MG4-138 effector
DESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHAIDAITIALSRPKMIAALSRNNAQDPYWPNNGRTTPKIQSPWKDFVDSIRPHFEQMLVSHRPEHRLTGALHDETNYGRPRKEGGKDVVHIRKPLVGKNKGEGLSSEDIENIVDPAVREAVKEKAVQFGGSLKTWTPNAAQDDWPLLKTKTGKQIPIKRVRIRKAIKVFPVGETAYRTRHVAPGADSIHHIAVYVTKDKHGRDKWISEIVRIFEEKQRWQAWKKKGGAVVPLVYSTHSEDKDAEFLFYLMKKDTLELEVNGKRAVYLVTSFESDGRINLIPINSSGKREDQKDSKIV

SEQ ID NO: 557 - protein, 1067 aa, unidentified
  REGION 1..1067: note = Description of Unknown:uncultivated organism
  REGION 1..1067: note = MG4-139 effector
MTESGSSQSNYVLGIDLGTTYAGWAAISLNQSGKPTGVLRAGVRVFDTTVTGNVEKGQDESNAIARRNARLVRRQLRRHVARQKALFQLLQQHGLLPPYQGTESDSSRQRHQILNALDHELVIKRASTGDANAKAAVELPLYLLRKIALDAALEPFELGRVFYHLSQRRGYKSNRKEKPTDKKKVAELGVVESGIEDLTEEMHRAHARTLGEYFASLDPHAQKIRGRWTARKMYEEEFALIWEKQATFRPDLLTEELHHQVKHLLFYQRPLKAQSHLIGRCELEPGERRAAWATLEAQEFRLLQEVNNLEIILPGSVIGVPLTAQQRQTVLDLLENSAEVTFKQIRKALGLANNAGFNLQHGGETRLKGNATNAYMNEVFGERWSAMPDGDKKQVVEDWRTIEQEDSLVRRAVSHWHLDEANAQWLASRSAPNGYCAFSRKAISKMLPFLAAGKSGQEAEIKIYGSRLSGGKVYDRIPPVRDFLKNLRNPAVERSLTELRKVVNALVQEYGKPVEIRIQLARELKKSRRERMESVSTNRDREKQRNAAKEKLLKELGLQHPSRADIEKALLWEECQGVCPYTGKQFPFSSLFGENPSMQVQHIIPFSRIPDDSFQNKTLCSVEENQYKANRTPFEAYADPAQYEAILDRVKNWPRPNRGKQRRFELRTLEELEGFSSRQLNCIRYASQMACKLMGTLYGGRDMETAGRSRQIIFASTGMLTGTLRRAWGLEAILREETPSSIEGKPRNDYRHHAIDAIAVALSHPKLIAALSRSDDSYAWATRALLKIESPWKNFIDSIRPHFDQMLISHRPEHRLTGEIHKATNYSMPHEEDGKQVVHLRRPVPGLTMKDIENIVDPATREAVRAKAVEYGNELVKWTPNQGGTDWPQLVNKSGKHIPIKKVRVKEVLNVRAIGKGESTRYVALKNNHHVAIFALLNEVADEKRWVPVVVSLFDAMQRKNKSEAVIQTTYSGSGKAAFKFSLMGGDTLLLHKDCDHGNSKCNPSVWQVRTIAASGQLSLVRINDARQKADILKAKEWWSPSVETLRKLEAIKVTIDSLGGIHQAGG

SEQ ID NO: 558 - protein, 1114 aa, unidentified
  REGION 1..1114: note = Description of Unknown:uncultivated organism with predicted taxonomy: Planctomycetesbacterium
  REGION 1..1114: note = MG4-140 effector
FQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRRIVVSRRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 559 - protein, 1079 aa, unidentified; identical to SEQ ID NO: 544
  REGION 1..1079: note = Description of Unknown:uncultivated organism
  REGION 1..1079: note = MG4-141 effector

SEQ ID NO: 560 - protein, 764 aa, unidentified
  REGION 1..764: note = Description of Unknown:uncultivated organism with predicted taxonomy: Polaribactersp. ALD11
  REGION 1..764: note = MG4-142 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGEYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEP

SEQ ID NO: 561 - protein, 1062 aa, unidentified
  REGION 1..1062: note = Description of Unknown:uncultivated organism
  REGION 1..1062: note = MG4-143 effector
MSSALEQQKYVLGLDLGSASLGWALIALNGADDPVSLIRAGVRIFEPGVDGTSIEIEQGKDQSKAVERRTARLHRRQLRRRAARQRDLFRVLQRHCLLPAPETLVGSPEEQRHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 562 - protein, 1076 aa, unidentified; identical to SEQ ID NO: 545
  REGION 1..1076: note = Description of Unknown:uncultivated organism
  REGION 1..1076: note = MG4-144 effector

SEQ ID NO: 563 - protein, 752 aa, unidentified
  REGION 1..752: note = Description of Unknown:uncultivated organism
  REGION 1..752: note = MG4-145 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNH

SEQ ID NO: 564 - protein, 1035 aa, unidentified
  REGION 1..1035: note = Description of Unknown:uncultivated organism with predicted taxonomy:Acidobacteriales bacterium 59-55
  REGION 1..1035: note = MG4-146 effector
LNGADDPVSLIRAGVRIFEPGVDGTSMEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 565 - protein, 1079 aa, unidentified; identical to SEQ ID NO: 544
  REGION 1..1079: note = Description of Unknown:uncultivated organism
  REGION 1..1079: note = MG4-147 effector

SEQ ID NO: 566 - protein, 1062 aa, unidentified; identical to SEQ ID NO: 549
  REGION 1..1062: note = Description of Unknown:uncultivated organism
  REGION 1..1062: note = MG4-148 effector

SEQ ID NO: 567 - protein, 1062 aa, unidentified
  REGION 1..1062: note = Description of Unknown:uncultivated organism
  REGION 1..1062: note = MG4-149 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLISEAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 568 - protein, 901 aa, unidentified
  REGION 1..901: note = Description of Unknown:uncultivated organism with predicted taxonomy: Polaribactersp. ALD11
  REGION 1..901: note = MG4-150 effector
SASLGWALIALDESDNPVSLIRAGVRIFEPGVDGAKPGTPASAQEIQFGKDQSTAVARRQERLRRRQLRRRVARQRKLFGVLQGAGLLPTGDVLGAGIGSEQRHRVLNNLDADLMNRYRSSADKANFGQMPLYALRKKALYEPLALDELGRVFFHLSQRRGFQSNRKDVQKKTKGSEDQGQVKSAIHELEQAIQVAGAQTLGEYLAGLDPHEQKVRRQWTGRKMFEKEFQMIWDKQKEYHTDLLTSELHGRIWDLLFFQRPVAAQKHLVGKCELEPDKRRAPWAALLAQQFRLLQKVNDLRLIEEDGNELPLNEDGRIAVFNLLENHGTQTFAKIKQHLGLPKTAEFNLERGKAKELKGNITAQSMRKVFGERWTQFSAGKQNQIVENWRNSEKDEELRREAMEHWGLDEAGANALVNEKAPGDYCSLSLMALGKILPLMRAGKSFKEAETEIYGNRFSGAAVHSLIPVLRPNRKHFRNSTPPPQDPLMASIANGLRNPAVERSITEMRKVVNAIVREYGKPCEIRIELARELKKPRSKRLDETARNRKREAENKALAERMHNECGMPQNSSRNDLEKAKLWVEQQGQCPYTGRSLPFSRLFDDNNGFDVDHILPRSRHPDDSYQNKVLCWGDTNRMVKRNQTPYEAFAEQDPENWHQILARVARWKNPGKSRKFEIRSTDELAEFSSRQLNDTRYTSLLAARLLSTLYGGRDLAENGRKRQIIFASSGAVTATLRRNWGFEQILRNIIPPEPNESSGKPRTDHRHHAIDAIVIALTRNDVIQAMARASALEPWQPGTRSWRHVPQPWHTPNFFRSVEEQVREMLTSHRPEHKVSGELHKGSNYGRPYLYNGKPTVHSRVSISALRSQDIEDDDVIVDRRVRDILRTKLAEIGGNPKAFEK

SEQ ID NO: 569 - protein, 1105 aa, unidentified; identical to SEQ ID NO: 555
  REGION 1..1105: note = Description of Unknown:uncultivated organism with predicted taxonomy:Acidobacteriales
  REGION 1..1105: note = MG4-151 effector

SEQ ID NO: 570 - protein, 1079 aa, unidentified; identical to SEQ ID NO: 544
  REGION 1..1079: note = Description of Unknown:uncultivated organism
  REGION 1..1079: note = MG4-152 effector

SEQ ID NO: 571 - protein, 1062 aa, unidentified; identical to SEQ ID NO: 549
  REGION 1..1062: note = Description of Unknown:uncultivated organism
  REGION 1..1062: note = MG4-153 effector

SEQ ID NO: 572 - protein, 1076 aa, unidentified
  REGION 1..1076: note = Description of Unknown:uncultivated organism with predicted taxonomy:Acidobacteriales bacterium 59-55
  REGION 1..1076: note = MG4-154 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPETLGGSPEEQRHSILNGLDQALARKWQSAFPDNRFAQLPLYYLRKRALDEPLEAHEIGRILFHLIQRRGFLSNRRENKQNPDQKKELGQVKAEIHSLEQEIQNAGARTLGEFFAGLDPHAQKVRRRWTARKMFQNEFEKIWEAQVIHCPNLLMPELHDKIAHLLFFQRPIATQSHLVGKCELEPGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFGDRWDRMSAGKQHQIVENWRNSESDEALIREAEEQWALDDTAATLLSEQIPEPGYCAVSLTAISKLLPLMQCGKSFKEAETVVYGARFSGGVVFDTLPEVRKQLESLRNPAVERALTELRKVVNAIVREYGKPYEIRIELARELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHKMSGELHKGTNYSTPYNYKGKPTVHTRCLLSALSAADIAGDEVIVDTAVRDAVRKKLAELGGNPKLFDRPENAPCLSARDGRLIPIRKVRVRETKNPVKVGKGVRERFTSSGGIHHVALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 573 - protein, 1026 aa, unidentified
  REGION 1..1026: note = Description of Unknown:uncultivated organism with predicted taxonomy:Deltaproteobacteria
  REGION 1..1026: note = MG4-155 effector
MEIQVAVPYVLGIDLGANSVGWAALLHEHGESVGILDLGVRIFAAGVTGLEAGRDESHAAARRVARLQRRQTDRRRRRIHKIYGILADYGLLPAKATPADRAKALSALDNELSARYGAHDNLPYVLRARALGEALSPFELGRALFHLAQRRGFLSNRKSTKEPDDEKGKVKSGITILAHAIAESGSRTLGEHLSRLDPHEARIRGRYTSRQMYLDEFDKIWESQAANHPELLNPERKRELLQAMFHQRPLRDQSDLIGDCELEEGEKRAPAWHPLAQRFRLLQEVNHLRLIDPAGVSRALSAEERQAVVPLLEKGDLPIRELRKLLEIKRNVEINLDRGGKKALIGDRTEEKMRGAFGAAWDALSQEEKLEAITDLAGDLGDTQLARKAQDRWGLSAEQAERYSSTSLEVGRYLGFSLKAIAKMLPLLESGADATTARDAAYPAGTFRTDLLGALPPVAERLKDLRNPAVLRSLTELRKVVNALIGRYGKPLEIHVELARDLKASRPEREDRWARMRRNEKARAEAAAKIQSEIGIHTPGRADTEKWLLAEECHWRCPYSGRGFSATQLYQSGEIQVEHIIPFSRSLDDSFANKTLAYSWVNKAKGNRSPREAFQEQSQWEAILTEVGSFHGPYAKHKLQRFQWTSEQIAELLDDFTKRQLNDTRYASKLAARYMACLYGGLSDSCGQRIFVSPGQVTAFLRRLWAIEGLLSGGGGKSRDDHRHHAIDAVVVALTGPAWVKALSDAASRAREEGRRRFASLEAPWPGFAAAVQDRLQGLTVSHRANLKVGGAMHDETFYGVIQHPELGPTAVCRKLVHRLSKEDLEHIVDPRVRERVALQLGLQGGDFKQLEAHPPTIPTHDGREVPIRKVRIMKAEHTRRIGQGARARNVMGDDYHHLEVIRQTDPRTGKTKWALAAVTCQQAMERVRDHKPLVSRDHGPHAEFVCSVAKDDTLEINEAGNKRLVVVKALEAGRNVVGFKDLRDARPYSATTKNRERVAVARLMDALKCRKVTVSPLGETHYAND

SEQ ID NO: 574 - protein, 1037 aa, unidentified
  REGION 1..1037: note = Description of Unknown:uncultivated organism with predicted taxonomy: Planctomycetesbacterium
  REGION 1..1037: note = MG4-156 effector
SMLGVDLGSAALGWAVVGVADGKPACHVDGGVRIFPEAVENLEQGKDDPKSAQRRLARQMRRQTDRRARRVASVFRVLQKAGLLPRFSEGADPADPLARHELINRLDEDLACTVPGLIDPAAEHRSRSVFHYRLRALAIHQDLPPYAIGRAFLHIAQRRGFKSGRIEEASGSEKAKERESDSRKERRQVAARIESLPAEFLRLGACTIGEYWSKLDPNQKRIRGIGNWSGRQMHVDEFDRIWERQAPRQQEIMTPLLYRIVKRRIFFQRPLKSAAGLIGHCELERESQRRRAPLAHPLYQRFRILQTVNDLRIVEGSGLSRPLTVEQRIKALDTLSRQQTVTFKSLHKKLGLVPGETFSHEEGDRKDLPGNRTECKLREVFGEQWDSLPEQQKNVIAGYVRSMDDSAVLARIAETRWGLGHLRAARLAGIQLEQGYGRLSVAALRKLLPLMEEGLPYMTAVERIYPDRAFAPTQELLPKVLDLKNVRNPAVVRALTELRKVVNGVIREYGRPERIQIELARELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQLNDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHHLRGALHAESLYSPPRSERGAAPRHRIRKWLSSLTPEQVRDIVDTKVREAVEAKLKELGQTDPRDAFKNNADPPTLGNRHGDPVPIRRVRVYVSVSPQRIGTGATARHVVSKDNHHLAIYRLSADKKGTARWTGEAVSLLEALKRMNLPGRPVIAPVNESGAPLVMALYKGDLVEMTVPKSQPPERDLFVVRGFSIEKRGGPEINFARHTLAAEMASQKKRGG

SEQ ID NO: 575 - protein, 1062 aa, unidentified
  REGION 1..1062: note = Description of Unknown:uncultivated organism
  REGION 1..1062: note = MG4-157 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 576 - protein, 1062 aa, unidentified; identical to SEQ ID NO: 549
  REGION 1..1062: note = Description of Unknown:uncultivated organism
  REGION 1..1062: note = MG4-158 effector

SEQ ID NO: 577 - protein, 1062 aa, unidentified; identical to SEQ ID NO: 549
  REGION 1..1062: note = Description of Unknown:uncultivated organism with predicted taxonomy:Acidobacteriales bacterium 59-55
  REGION 1..1062: note = MG4-159 effector

SEQ ID NO: 578 - protein, 1075 aa, unidentified
  REGION 1..1075: note = Description of Unknown:uncultivated organism with predicted taxonomy: Planctomycetes
  REGION 1..1075: note = MG4-160 effector
MAAAKKPYILGLDLGVQSAGWAMIDVDDHGRPCGIRRSGVRCFDSGVGSETEIASGKDESQNIKRRQMRLQRRQLWRRGRRLKKVFLVLQKAGILPPGETRSPEQRHELLKLLDAELAKTHLPEHDRVAGHLLPYRLRALALDQALPPFAFGRALFHLAQRRGFLSIRKSASKDGDDEGAVKAGIAELQQNMQEAGVRTLGEYFSKLDPEAEKQRIRKRWTARSMYLDEFEKIWVAQSPHHPMLGEEWKTRVYDAIFHQRPLKSQKGLVGVCELEPTCRRAPRASVEAQRFRYLQKVNDLEIVTPDGEIWALTDPEHVDLRKKLIELLDTQAEVKFASLRSKLGLWAKLGRKKPKGTDKDFTFNLEAGGESKLKGNTTATKIRGVLGDDYGKLSPEQLAGLVDDLLEYEKKEALARRLTKNYEIAPAKADQLADVTLEPNYASLSREAMHKLLPIMENGRRFASLTQEELEKLFPNRRKGGITYDLLPPVLGIIDLRNPVVCRGLTELRKVLNALIRQYGKPELIRVELARDLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARMLQDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRRVTGALHEETNYSKPHKSRDGNGNGKEVEYRHVRKPLQNMSANEVENIVDDIIRKLVQTKLDQIGGEPKKVFADPGNHPYLTAKDGRRIFIHKARIRKTVAVIPLGKSSSPRYAAPGSNHHMEIFATLDQEGKENRWESKIVSLFEAHRRVRAGEPVIQRDHGSNTEFKFSLAGGEYLELDDDGGGRRLVRITVISGKIAEFRLHTDARPITILRQTKGGRAGLSKPVDSLRKANARKVVVDPLGNILPAND

SEQ ID NO: 579 - protein, 780 aa, unidentified
  REGION 1..780: note = Description of Unknown:uncultivated organism with predicted taxonomy:Acidobacteriales bacterium 59-55
  REGION 1..780: note = MG4-161 effector
LETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 580 - protein, 792 aa, unidentified
  REGION 1..792: note = Description of Unknown:uncultivated organism
  REGION 1..792: note = MG4-162 effector
LHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIDLDRDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWS

SEQ ID NO: 581 - protein, 1106 aa, unidentified
  REGION 1..1106: note = Description of Unknown:uncultivated organism with predicted taxonomy:Acidobacteriales bacterium 59-55
  REGION 1..1106: note = MG4-163 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLSQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWRTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 582 - protein, 1015 aa, unidentified
  REGION 1..1015: note = Description of Unknown:uncultivated organism
  REGION 1..1015: note = MG4-164 effector
ARRVARLLRRQLRRRSARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLRSIAANGQLSLVRINDARPKSEIIKAKEWWSPIEDTLRELDAVKVVIDSLGRIHQAGG

SEQ ID NO: 583 - protein, 1062 aa, unidentified; identical to SEQ ID NO: 549
  REGION 1..1062: note = Description of Unknown:uncultivated organism
  REGION 1..1062: note = MG4-165 effector

SEQ ID NO: 584 - protein, 1076 aa, unidentified; identical to SEQ ID NO: 572
  REGION 1..1076: note = Description of Unknown:uncultivated organism with predicted taxonomy: CandidatusSulfotelmatomonas gaucii
  REGION 1..1076: note = MG4-166 effector

SEQ ID NO: 585 - protein, 1105 aa, unidentified; identical to SEQ ID NO: 555
  REGION 1..1105: note = Description of Unknown:uncultivated organism with predicted taxonomy:Acidobacteriales bacterium 59-55
  REGION 1..1105: note = MG4-167 effector

SEQ ID NO: 586 - protein, 890 aa, unidentified
  REGION 1..890: note = Description of Unknown:uncultivated organism
  REGION 1..890: note = MG4-168 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKW

SEQ ID NO: 587 - protein, 1062 aa, unidentified; identical to SEQ ID NO: 575
  REGION 1..1062: note = Description of Unknown:uncultivated organism
  REGION 1..1062: note = MG4-169 effector

SEQ ID NO: 588 - protein, 1079 aa, unidentified; identical to SEQ ID NO: 544
  REGION 1..1079: note = Description of Unknown:uncultivated organism
  REGION 1..1079: note = MG4-170 effector

SEQ ID NO: 589 - protein, 902 aa, unidentified
  REGION 1..902: note = Description of Unknown:uncultivated organism
  REGION 1..902: note = MG4-171 effector
ILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 590 - protein, 1062 aa, unidentified
  REGION 1..1062: note = Description of Unknown:uncultivated organism
  REGION 1..1062: note = MG4-172 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 591 - protein, 766 aa, unidentified
  REGION 1..766: note = Description of Unknown:uncultivated organism with predicted taxonomy:Ignavibacteriales bacterium CG_4_9_14_3_um_filter_30_11
  REGION 1..766: note = MG4-173 effector
LRLRLDDGNERKLTPNERAVLLDLCEKREKLTIAKARSEIGISKGQKFTIEEGGEKNVPVNLTATRLRAALGQTWDGLTPLQKDDLVEDVGDGKRNPTDEGLERCGRDKWGLPQEIAEALGKVRLPDAYGRYSLRALVALLPAIEEGLTVEDAIRALYAGARKSAEPLPLLPPVRDEKMKTLLGEIRSPAVQRSLTELRKTVNAIIRRYGLPEKIHIELARDLKKSKKERQKQTEINRDREKLRQEATGELRKHDVVRFANPRNSDIEKYLLATEARWQCPYTSKKYGVTDVFGDHPQVDVEHIIPRSRSLDDSYLNKTLAYRSANMEKGNRTPREWLFESDQEQYDRMIGVVSGFDPRFEVGKKLRRFSMELSDPDSLLKEFTERQLQDTRYASKLACRYLGVLYGGTSDASGNQRVFASAGQVTAKLRRAWDLDRILSPDKPEKSRDDHRHHAIDALTVALSSTTLIRALATAAGEADRLFRRKIILPVPWVGFGEQARSAVENIQPSHRPMRKLSGPLHKETFYSRPRKHAVGTDRKGKPIEEECVHYRVPVTSLSSAKSFESIVDSRVRAAVEERAAQLGGGGNRFEKNWPELVTRKGQTVPIKRVRIRKVEGVVSIGKNGRERFVIPGSNHHAEILAELDANGRVKRYLCETVTMLEAVERKRQSVPVVNRDHGPGYKFHCTLSEGDLVEARGPGDEASRIWKVRTVRESQQLALTPALDARPKAVVQKDGMWSPSVNPLFRGGARKVLITPLGEVIPAND

SEQ ID NO: 592 - protein, 764 aa, unidentified
  REGION 1..764: note = Description of Unknown:uncultivated organism with predicted taxonomy: unculturedbacterium
  REGION 1..764: note = MG4-174 effector
MSDNGSLAQDYILGVDLGSASLGWAAIRQDENGMATRLLRAGVRIFDPAVSGDVEKGQDESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHA

SEQ ID NO: 593 - protein, 1079 aa, unidentified; identical to SEQ ID NO: 544
  REGION 1..1079: note = Description of Unknown:uncultivated organism
  REGION 1..1079: note = MG4-175 effector

SEQ ID NO: 594 - protein, 1062 aa, unidentified
  REGION 1..1062: note = Description of Unknown:uncultivated organism with predicted taxonomy:Acidobacteriales bacterium 59-55
  REGION 1..1062: note = MG4-176 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 595 - protein, 948 aa, unidentified
  REGION 1..948: note = Description of Unknown:uncultivated organism
  REGION 1..948: note = MG4-177 effector
MSFPDGVRQKYILGLDLGSASIGWAVIDLDGNLDPCGLLAAGSHIFDPGVEVPPAAGKMARDEAVFQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDPWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLL

SEQ ID NO: 596 - protein, 878 aa, unidentified
  REGION 1..878: note = Description of Unknown:uncultivated organism with predicted taxonomy:Acidobacteriales bacterium 59-55
  REGION 1..878: note = MG4-178 effector
KKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 597 - protein, 1106 aa, unidentified
  REGION 1..1106: note = Description of Unknown:uncultivated organism with predicted taxonomy: Acidobacteria
  REGION 1..1106: note = MG4-179 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 598 - protein, 1076 aa, unidentified; identical to SEQ ID NO: 545
  REGION 1..1076: note = Description of Unknown:uncultivated organism
  REGION 1..1076: note = MG4-180 effector

SEQ ID NO: 599 - protein, 1079 aa, unidentified; identical to SEQ ID NO: 544
  REGION 1..1079: note = Description of Unknown:uncultivated organism
  REGION 1..1079: note = MG4-181 effector

SEQ ID NO: 600 - protein, 1062 aa, unidentified; identical to SEQ ID NO: 549
  REGION 1..1062: note = Description of Unknown:uncultivated organism
  REGION 1..1062: note = MG4-182 effector

SEQ ID NO: 601 - protein, 766 aa, unidentified
  REGION 1..766: note = Description of Unknown:uncultivated organism
  REGION 1..766: note = MG4-183 effector
MSDNGSLAQDYILGVDLGSASLGWAAIRQDENGMATRLLRAGVRIFDPAVSGDVEKGQDESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHAID

SEQ ID NO: 602 - protein, 1076 aa, unidentified; identical to SEQ ID NO: 545
  REGION 1..1076: note = Description of Unknown:uncultivated organism
  REGION 1..1076: note = MG4-184 effector

SEQ ID NO: 603 - protein, 1062 aa, unidentified
  REGION 1..1062: note = Description of Unknown:uncultivated organism
  REGION 1..1062: note = MG4-185 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 604 - protein, 1079 aa, unidentified; identical to SEQ ID NO: 544
  REGION 1..1079: note = Description of Unknown:uncultivated organism
  REGION 1..1079: note = MG4-186 effector

SEQ ID NO: 605 - protein, 794 aa, unidentified
  REGION 1..794: note = Description of Unknown:uncultivated organism with predicted taxonomy: Polaribactersp. ALD11
  REGION 1..794: note = MG4-187 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIEKDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 606 - protein, 1062 aa, unidentified
  REGION 1..1062: note = Description of Unknown:uncultivated organism with predicted taxonomy:Acidobacteriales bacterium 59-55
  REGION 1..1062: note = MG4-188 effector
MSAALEQQKYVLGLDLGSASLGWALIALNGADDPVSLIRAGVRIFEPGVDGTSMEIEQGKDQSKAVERRTARLHRRQLRRRAARQRDLFRVLQRHCLLPAPETLVGSPEEQRHSVLNELDQELTQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 607 - protein, 1106 aa, unidentified; identical to SEQ ID NO: 597
  REGION 1..1106: note = Description of Unknown:uncultivated organism with predicted taxonomy: Polaribactersp. ALD11
  REGION 1..1106: note = MG4-189 effector

SEQ ID NO: 608 - protein, 1076 aa, unidentified; identical to SEQ ID NO: 545
  REGION 1..1076: note = Description of Unknown:uncultivated organism
  REGION 1..1076: note = MG4-190 effector

SEQ ID NO: 609 - protein, 1079 aa, unidentified; identical to SEQ ID NO: 544
  REGION 1..1079: note = Description of Unknown:uncultivated organism
  REGION 1..1079: note = MG4-191 effector

SEQ ID NO: 610 - protein, 983 aa, unidentified
  REGION 1..983: note = Description of Unknown:uncultivated organism
  REGION 1..983: note = MG4-192 effector
RRAARQRDLFRVLQRHCLLPAPETLVGSPEEQRHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 611 - protein, 1062 aa, unidentified; identical to SEQ ID NO: 549
  REGION 1..1062: note = Description of Unknown:uncultivated organism with predicted taxonomy:Acidobacteriales bacterium 59-55
  REGION 1..1062: note = MG4-193 effector

SEQ ID NO: 612 - protein, 1022 aa, unidentified
  REGION 1..1022: note = Description of Unknown:uncultivated organism
  REGION 1..1022: note = MG4-194 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLR

SEQ ID NO: 613 - protein, 1062 aa, unidentified; identical to SEQ ID NO: 594
  REGION 1..1062: note = Description of Unknown:uncultivated organism
  REGION 1..1062: note = MG4-195 effector

SEQ ID NO: 614 - protein, 862 aa, unidentified
  REGION 1..862: note = Description of Unknown:uncultivated organism with predicted taxonomy:Acidobacteriales bacterium 59-55
  REGION 1..862: note = MG4-196 effector
DKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 615 - protein, 1062 aa, unidentified
  REGION 1..1062: note = Description of Unknown:uncultivated organism
  REGION 1..1062: note = MG4-197 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 616 - protein, 1084 aa, unidentified
  REGION 1..1084: note = Description of Unknown:uncultivated organism
  REGION 1..1084: note = MG4-198 effector
MSAKSEELKGAPYILGLDLGAASLGWAVVGLADGKPACHVDGGVRIFPEAVENLEQGKDDPKSAQRRLARQMRRQTDRRARRVASVFRVLQKAGLLPRFSEGADPADPLARHELINRLDEDLACTVPGLIDPAAEHRSRSVFHYRLRALAIHQDLPPYAIGRAFLHIAQRRGFKSGRIEEASGSEKAKERESDSRKERRQVAARIESLPAEFLRLGACTIGEYWSKLDPNQKRIRGIGNWSGRQMHVDEFDRIWERQAPRQQEIMTPLLYRIVKRRIFFQRPLKSAAGLIGHCELERESQRRRAPLAHPLYQRFRILQTVNDLRIVEGSGLSRPLTVEQRIKALDTLSRQQTVTFKSLHKKLGLVPGETFSHEEGDRKDLPGNRTECKLREVFGEQWDSLPEQQKNVIAGYVRSMDDSAVLARIAETRWGLGHLRAARLAGIQLEQGYGRLSVAALRKLLPLMEEGLPYMTAVERIYPDRAFAPTQELLPKVLDLKNVRNPAVVRALTELRKVVNGVIREYGRPERIQIELARELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQLNDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHHLRGALHAESLYSPPRSERGAAPRHRIRKWLSSLTPEQVRDIVDTKVREAVEAKLKELGQTDPRDAFKNNADPPTLGNRHGDPVPIRRVRVYVSVSPQRIGTGATARHVVSKDNHHLAIYRLSADKKGTARWTGEAVSLLEALKRMNLPGRPVIAPVNESGAPLVMALYKGDLVEMTVPKSQPPERDLFVVRGFSIEKRGGPEINFVRHNLAAEIADLKDAGEWQRIRSWDELRLLNPRIVRLGAMGRVMPDDSQPNS

SEQ ID NO: 617 - protein, 1079 aa, unidentified; identical to SEQ ID NO: 544
  REGION 1..1079: note = Description of Unknown:uncultivated organism
  REGION 1..1079: note = MG4-199 effector

SEQ ID NO: 618 - protein, 1079 aa, unidentified; identical to SEQ ID NO: 544
  REGION 1..1079: note = Description of Unknown:uncultivated organism
  REGION 1..1079: note = MG4-200 effector

SEQ ID NO: 619 - protein, 1106 aa, unidentified
  REGION 1..1106: note = Description of Unknown:uncultivated organism with predicted taxonomy:Acidobacteriales bacterium 59-55
  REGION 1..1106: note = MG4-201 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTSPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 620 - protein, 1062 aa, unidentified; identical to SEQ ID NO: 549
  REGION 1..1062: note = Description of Unknown:uncultivated organism with predicted taxonomy:Acidobacteriales bacterium 59-55
  REGION 1..1062: note = MG4-202 effector

SEQ ID NO: 621 - protein, 1062 aa, unidentified
  REGION 1..1062: note = Description of Unknown:uncultivated organism with predicted taxonomy:Acidobacteriales bacterium 59-55
  REGION 1..1062: note = MG4-203 effector
MSSALEQQKYVLGLDLGSASLGWALIALNGADDPVSLIRAGVRIFEPGVDGTSMEIEQGKDQSKAVERRTARLHRRQLRRRAARQMDLFRVLQRHFLLPSPETLFGSPEEQMHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 622 - protein, 830 aa, unidentified
  REGION 1..830: note = Description of Unknown:uncultivated organism with predicted taxonomy:Acidobacteriales bacterium 59-55
  REGION 1..830: note = MG4-204 effector
MFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 623 - protein, 819 aa, unidentified
  REGION 1..819: note = Description of Unknown:uncultivated organism with predicted taxonomy: Acidobacteria
  REGION 1..819: note = MG4-205 effector
MAAIAPPSFRPGLVLGIDLGSNSLGTALIRTDLDLIEFMGVRIFPAGVEGNLEEGKEESRAAKRRQARLARRQTQRRQRRLYKVFHFLQRIGLLPTGDRLEVLGRLQNELEHCYPQTTVLPWFLRARALDQALGPHELGLALYHLAQRRGFLSNRAGGKDNEKERSEVKASIKGLAAAIEAAGKRTLGEYMASLNPREKLRNSAEFSGHYTHRSMFEREFDMIWDSQKAHHPEILTENHGAKLHDAMFHQRPLKDQSYLVGQCELEPTEKRAPLRLLAAQRFRILGFVNNLRLRLEDGNERKLTPNERAVLLDLCEKAEKLSLAAARRVLGLSTAQRFTIEEGGEKNVPVNLTATRLRAALGQAWDGLTAAQKDDLIEDVGDGKRCPTDEDLERCGREKWGWPQEVANALSKVRLPDGYGRYSLRALVALLPALEGGITVEEAIRAIPAYAETRNAAEPLPMLPPVRDLKAMLGEIRNPAVLRSLTELRKTVNAIIRRYGIPEQIHIELARDLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQLQDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRKLAGPLHEETFYSR

SEQ ID NO: 624 - protein, 1062 aa, unidentified
  REGION 1..1062: note = Description of Unknown:uncultivated organism
  REGION 1..1062: note = MG4-206 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 625 - protein, 1056 aa, unidentified
  REGION 1..1056: note = Description of Unknown:uncultivated organism
  REGION 1..1056: note = MG4-207 effector
MAAIAPPSFRPGLVLGIDLGSNSLGTALIRTDLDLIEFMGVRIFPAGVEGNLEEGKEESRAAKRRQARLARRQTQRRQRRLYKVFHFLQRIGLLPTGDRLEVLGRLQNELEHCYPQTTVLPWFLRARALDQALGPHELGLALYHLAQRRGFLSNRAGGKDNEKERSEVKASIKGLAAAIEAAGKRTLGEYMASLNPREKLRNSAEFSGHYTHRSMFEREFDMIWDSQKAHHPEILTENHGAKLHDAMFHQRPLKDQSYLVGQCELEPTEKRAPLRLLAAQRFRILGFVNNLRLRLEDGNERKLTPNERAVLLDLCEKAEKLSLAAARRVLGLSTAQRFTIEEGGEKNVPVNLTATRLRAALGQAWDGLTAAQKDDLIEDVGDGKRCPTDEDLERCGREKWGWPQEVANALSKVRLPDGYGRYSLRALVALLPALEGGITVEEAIRAIPAYAETRNAAEPLPMLPPVRDLKAMLGEIRNPAVLRSLTELRKTVNAIIRRYGIPEQIHIELARDLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQLQDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRKLAGPLHEETFYSRPRKEAVGTDKKGNPIKKEFVHYRVPVTSLASAKDFESIVDSHVRAAVKEKAAQLGGGGNKFEKNWPALVTRKGQTVPIRRVRIRKVQSVVSIGKDERKRFVVPGSNHHAEILKELDANGRVKRYLCETVTMLKALERKRQGVPVVSRDHGPGYKFHCTLSEGDLVEARGPGDEALRIWKVRTVRDSQQLALTPALDARPKADVQKDGMWSPRVNSLFLGGARKVLITPLGEVIPAND

SEQ ID NO: 626 - protein, 1076 aa, unidentified; identical to SEQ ID NO: 545
  REGION 1..1076: note = Description of Unknown:uncultivated organism
  REGION 1..1076: note = MG4-208 effector

SEQ ID NO: 627 - protein, 1079 aa, unidentified; identical to SEQ ID NO: 544
  REGION 1..1079: note = Description of Unknown:uncultivated organism
  REGION 1..1079: note = MG4-209 effector

SEQ ID NO: 628 - protein, 827 aa, unidentified
  REGION 1..827: note = Description of Unknown:uncultivated organism with predicted taxonomy: candidatedivision Kazan bacterium
  REGION 1..827: note = MG4-210 effector
QMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSH

SEQ ID NO: 629 - protein, 845 aa, unidentified
  REGION 1..845: note = Description of Unknown:uncultivated organism with predicted taxonomy:Acidobacteriales bacterium 59-55
  REGION 1..845: note = MG4-211 effector
RIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 630 - protein, 1076 aa, unidentified; identical to SEQ ID NO: 545
  REGION 1..1076: note = Description of Unknown:uncultivated organism
  REGION 1..1076: note = MG4-212 effector

SEQ ID NO: 631 - protein, 1106 aa, unidentified; identical to SEQ ID NO: 597
  REGION 1..1106: note = Description of Unknown:uncultivated organism with predicted taxonomy: Polaribactersp. ALD11
  REGION 1..1106: note = MG4-213 effector

SEQ ID NO: 632 - protein, 1079 aa, unidentified; identical to SEQ ID NO: 544
  REGION 1..1079: note = Description of Unknown:uncultivated organism
  REGION 1..1079: note = MG4-214 effector

SEQ ID NO: 633 - protein, 1109 aa, unidentified
  REGION 1..1109: note = Description of Unknown:uncultivated organism
  REGION 1..1109: note = MG4-215 effector
RSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 634 - protein, 1062 aa, unidentified
  REGION 1..1062: note = Description of Unknown:uncultivated organism
  REGION 1..1062: note = MG4-216 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 635 - protein, 754 aa, unidentified
  REGION 1..754: note = Description of Unknown:uncultivated organism with predicted taxonomy: candidatedivision Zixibacteria bacterium CG_4_9_14_3_um_filter_46_8
  REGION 1..754: note = MG4-217 effector
LSENTPRIAEDLILGLDLGTNSLGWCLLSAPEGNPASIVAIGVRSFDAGGDISAANGKSPCVIRREARVARRVVARRAKRLRDALRALQAAGLLPAGKAKDVIPPLDAAWLEERLSSFPQRDPERLRQAHLLPYLLRKEALDRPLTRQELGRALYHLAQRRGFLTNRKAEPKKDEKPGEVKQSIDSLRGKMEQAHARTLGEYFAGLDPQETRIRRRWTARGMYLDEFECIWTAQAPHHAEVLTSALKADLYRAIFRKRPMSSAASLVGPCAHEPNRRRAPACILPAQRFRLLQQVINCRVIEPNQVGRLLTDEEFAKLVQALEERDEMTVTEAKKVLGLPSRSKFTFEEGGEKKFNGNGTNAGLANVFGPAWETFTPDQRDAVVTEVRSFEDPEALIRRATSGRAFWNLDAQAGKALADVRLQQGYCALSRRALERLLPLMESRVPYQTAVEQIYKESCRKTAVKDLLPRVSELKELRNPVVSRVLTETRKVVNAIIRKYGIPGRVRIELGRDLKQSKDHRLRATKNARDNEESRKAAIRKILAETPVRSPGPDDILRAQLYEECNHECPYTGRKIAFAALFGDSPQFDIEHIIPFSRCLDDSFANKTLCYHEVNRHVKGNRTPLEAFGSTPEWERIVQSVRLFSGKAAEGKLRRFLMTEEEILKLQDFANSQLSDTRYASKLAMRYLALLYGGLSDEGGTQRIQAGSGNVTKHVRQAHRLNGILGDGPGKNRNDHRHHAVDALAIALTDQALV

SEQ ID NO: 636 - protein, 1045 aa, unidentified
  REGION 1..1045: note = Description of Unknown:uncultivated organism with predicted taxonomy:Planctomicrobium piriforme
  REGION 1..1045: note = MG4-218 effector
MANPTGVPYILGLDIGASSIGWALLAANTDRSERLLRCGARVFDAGMEEGDFSAGKENSRSAVRRLARQARKLTSRRMRRQRKLFNLLVKAGLLPAGEPSQVVPALDADLRRKHVAMLPKGSDARRQAEHVLPYRLRALALDQKLEALELGRAIYHLAQRRGFLSNRKAPPRKDEKPGEVKEHITELEKNIKAAGARTLGKYLSGLDPEQERIRRRWTSRPMYLDEFAVLWAAQAAYHPAILTDDLRKRIHRAIFHQRPLKNQSNLIGTCELERGRQRAPKALLLFQRFRTLQQITSARVVARSGAGRELGAAERATLLAALDRQGELAFSKAKKLIGLPPGSTFNWESGGEDKFNGNHTGARLAEIFGDRWHRMCPSGKDQVVEDVLSIHSDAALERRGLKWDLDSEAAARFGHVNLEDGHGGLSRQALQKLVPLMEQGVPYATAVDKVYGRKEHKPLEVLPPPAPTYPHLRNPMVLRVLAELRKVVNAVIAAHGKPDAVRVELARDMRRSKKQRQESWLRMRQNERDRKRAAQKILAEMNNDSPSRQDKEKVLLAEECNWTCPYTGKCISMQSLLGPTPQFDIEHIIPFSRSLDDSFTNKTLCDIAENRDHKRNRTPFEAYAAEPDKWNAILGRVGRFRSNAREEKVRRFRQEEIEGIEDFAARQLNDTRYATRQATDYLALLYGGLYEKGGKRFIQAAKGGTTAYLRNEWQLNSILGDGGTKSRDDHRHHAVDAVAIALTDAGTVKMLSDAAGRAAQEGRRRFGRVEDPWPGFLDDVRQAIEGLNVSHRVSRKVNGPLHEETNYGPGKKRDAAGRPESLSVRKRLDALTPADMKLIADERVRGLVTAKLATLGGDAKKAFSDVKNHPCFELKDGRRIPIHAVRLRRSGTALAVGEGARVRYVLTGSNHHMELYEVTDAKGKTRWKGRVVSRFEAIRRQGRKQPVVDRTPPDGGTFKFSLAPGEIVHLTDEKGEARLYRVRTVSQAASGSIEIAGAKVNDARLKDEIIKGGDWLRITSMDKVAAMSCHKVIITPLGEIRDAND

SEQ ID NO: 637 - protein, 1076 aa, unidentified
  REGION 1..1076: note = Description of Unknown:uncultivated organism with predicted taxonomy: CandidatusSulfotelmatomonas gaucii
  REGION 1..1076: note = MG4-219 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPETLGGSPEEQRHSILNGLDQALARKWQSAFPDNRFAQLPLYYLRKRALDEPLEAHEIGRILFHLIQRRGFLSNRRENKQNPDQKKELGQVKAEIHSLEQEIQNAGARTLGEFFAGLDPHAQKVRRRWTARKMFQNEFEKIWEAQVIHCPNLLMPELHDKIAHLLFFQRPIATQSHLVGKCELEPGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFGDRWDRMSAGKQHQIVENWRNSESDEALIREAEEQWSLDDTAATLLSEQIPEPGYCAVSLTAISKLLPLMQCGKSFKEAETVVYGARFSGGVVFDTLPEVRKQLESLRNPAVERALTELRKVVNAIVREYGKPYEIRIELARELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHKMSGELHKGTNYSTPYNYKGKPTVHTRCLLSALSAADIAGDEVIVDTAVRDAVRKKLAELGGNPKLFDRPENAPCLSARDGRLIPIRKVRVRETKNPVKVGKGVRERFTSSGGIHHVALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 638 - protein, 1068 aa, unidentified
  REGION 1..1068: note = Description of Unknown:uncultivated organism with predicted taxonomy: Proteobacteria
  REGION 1..1068: note = MG4-220 effector
MSTALVPSDYILGIDLGSNSIGWAMIGLDQGKPTGLIRAGARVFDAGMEGDLESGQEESRNVARRDARMQRRQMARRARRLTKIFHILQRIGLLPPADLKTPEQRQEFLNQLDSNIIGSDWFKTKRAGNNFGEIDQVMPYLLRAAALDEPLDPHQLGRALYHLGQRRGFLSNRKKPMKKGEDEGVVKESIAELRQKMQESGARTLGEYFMRINPFERRIRQRWTHRDMYEGEFEKIWEAQAAHHPLLLTPERKKELKRAIFYQRPLRFPRELVGHCELEPEEIRAPRHYFIAQRFRLLQSLNNLRVAMPGEAERDLTAEERAKLDNELELHGDRTFGQIRKLLGIKRATFNLESGGEKLLRGNRTTAQFYKVFGERWLEMSSVEHEQALQDVRSIVKDETRLRRGSEHWKLDPEHAREFAAISLEPDYFNLSRKAMERLLPLLETGVSYATARRQLYPERFQAREPVPLLPPLHDVFEYLRNPAVERSLTELRKVVNALVRQYGKPAQIRLELARDLRKSRKEREANWKKNRDIEKSRKIMAERITAEAGITDPSREDIRKALLAKECGWVCPYTGRAISMRALVGPDAQFDIEHIIPFSQSLDNSFFNVTLCYHEENRNRKRNQTPYGAYGNEPEKFQEILDRVRRFDSDLADEKLKRFQLTDTADILKGFVDRQLNDTRYASTMAGDYLGFLYGGKIDSQRNLRVRATTGQVTAYLRDEWMLNRILRDGPTEQGGKVAKSREDHRHHAVDAIAIALTDESTIQQLSRAAQQAPQLGRRRFAPVQAPWPDFVDSVRAEIGRIVVSHRPNRKVSGALHEETLYSKSMPVPDSLKSQEKAPRVRKPLERLSKSEVEDIADPIVREMVQKKLEQLDGDPKKFSVAANLPFFKTADGREIPIKSVRVIKKTPTFPLGMGSRMRNVTSESNHHLEIFAELDEHGEEVEWDGVVVPMAEAYKRLAEAKRLRTKVPIVQRDFGAHRHFKFSLAAGDVVQCDNNHEGRRLLVVRGTSIEGGKTGRVALVPINDARKKNEIVASKDYFRFPLEKLRKLHTCKVTLSPLGDLGTAND

SEQ ID NO: 639 - protein, 876 aa, unidentified
  REGION 1..876: note = Description of Unknown:uncultivated organism with predicted taxonomy:Acidobacteriales bacterium 59-55
  REGION 1..876: note = MG4-221 effector
TGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 640 - protein, 1062 aa, unidentified
  REGION 1..1062: note = Description of Unknown:uncultivated organism
  REGION 1..1062: note = MG4-222 effector
MSSALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 641 - protein, 1079 aa, unidentified; identical to SEQ ID NO: 544
  REGION 1..1079: note = Description of Unknown:uncultivated organism
  REGION 1..1079: note = MG4-223 effector

SEQ ID NO: 642 - protein, 1076 aa, unidentified; identical to SEQ ID NO: 545
  REGION 1..1076: note = Description of Unknown:uncultivated organism
  REGION 1..1076: note = MG4-224 effector

SEQ ID NO: 643 - protein, 1179 aa, unidentified
  REGION 1..1179: note = Description of Unknown:uncultivated organism
  REGION 1..1179: note = MG4-225 effector
MSFPDGVRQKYILGLDLGSASIGWAVIDLDGNLDPCGLLAAGSHIFDPGVEVPPAAGKMARDEAVFQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKNNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTLYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 644 - protein, 794 aa, unidentified
  REGION 1..794: note = Description of Unknown:uncultivated organism with predicted taxonomy: Polaribactersp. ALD11
  REGION 1..794: note = MG4-226 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQNEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 645 - protein, 1079 aa, unidentified; identical to SEQ ID NO: 544
  REGION 1..1079: note = Description of Unknown:uncultivated organism
  REGION 1..1079: note = MG4-227 effector

SEQ ID NO: 646 - protein, 1059 aa, unidentified
  REGION 1..1059: note = Description of Unknown:uncultivated organism
  REGION 1..1059: note = MG4-247 effector
MKVKQESPQLILGLDIGTNSIGWSLLEDKGQDQGRIVGSGVRVYEAGMEGLIEQGKEESRNKNRRDARLHRRNLQRRARRMGGLWSLLQSSGLLPEGKAEGVLPELDKGLSETWTKKLGLDTKDKVGEKTQFSHVFPYFLRARALDEKLSCHELGRALYHLAQRRGFLSNRKAAPKKKEEEKGMKAEISELGRKIEESEARTLGEYFSRLNPEEGRIRSKHTSRKMYQEEFEAIWNAQTPHYPTILTEELKKKVSHAIFYQRPLKIRKEFIGNCEHEHNPDHPDRSPRRAPWALLDAQRFRLLQKVNDLVLTDTSTGEVRKLTPDERTKLLEALETQGDLTFGKIRKLTGLRKARFNFEAGGNDKLPGNRTASKLIKIFGEEKWKEFSTEQREQIVEDVHSIQSEEAQARRGIRAWGLEGEKAKDFGQLALEDGYCNLSRQALAKLLPRMEKGTAYKTAVKEVYGEPPAEKPLDSLPLVTEHLSSLRNPAVTRTLTELRKVVNNVVRQYGKPNMTRIELARDLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQLPDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRKVSGPLHKGTNYSKPIRGTDKKGNPCEFRRVRKPLAELSEPEIKDVADPTIRQLVLDKLQALGVKEPKKAFSSNEANHPCLTTKDGREIPIHKVRINKKVTPFTVGEGLRQRHVTTESNHHIEVVEVLDKNGKPKWEGCLVSLKDAYDRLKAGLPVVKLDHGEGRRFVFSLAKGEAIKIDEENGGNRGLYVVKKLGDNRIWFVDTREARKLKEAGYNSKLMEPLRTLNCQKVLITPLGEVRRAND

SEQ ID NO: 647 - protein, 1014 aa, unidentified
  REGION 1..1014: note = Description of Unknown:uncultivated organism with predicted taxonomy: Planctomycetes
  REGION 1..1014: note = MG4-248 effector
MKVKQESPQLILGLDIGTNSIGWSLLEDKGQDQGRIVGSGVRVYEAGMEGLIEQGKEESRNKNRRDARLHRRNLQRRARRMGGLWSLLQSSGLLPEGKAEGVLPELDKGLSETWTKKLGLDTKDKVGEKTQFSHVFPYFLRARALDEKLSCHELGRALYHLAQRRGFLSNRKAAPKKKEEEKGMKAEISELGRKIEESEARTLGEYFSRLNPEEGRIRSKHTSRKMYQEEFEAIWNAQTPHYPTILTEELKKKVSHAIFYQRPLKIRKEFIGNCEHEHNPDHPDRSPRRAPWALLDAQRFRLLQKVNDLVLTDTSTGEVRKLTPDERTKLLEALETQGDLTFGKIRKLTGLRKARFNFEAGGNDKLPGNRTASKLIKIFGEEKWKEFSTEQREQIVEDVHSIQSEEAQARRGIRAWGLEGEKAKDFGQLALEDGYCNLSRQALAKLLPRMEKGTAYKTAVKEVYGEPPAEKPLDSLPLVTEHLSSLRNPAVTRTLTELRKVVNNVVRQYGKPNMTRIELARDLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQLPDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRKVSGPLHKGTNYSKPIRGTDKKGNPCEFRRVRKPLAELSEPEIKDVADPTIRQLVLDKLQALGVKEPKKAFSSNEANHPCLTTKDGREIPIHKVRINKKVTPFTVGEGLRQRHVTTESNHHIEVVEVLDKNGKPKWEGCLVSLKDAYDRLKAGLPVVKLDHGEGRRFVFSLAKGEAIKIDEENGGNRGLYVVKKLGDNRI

SEQ ID NO: 648 - protein, 1134 aa, unidentified
  REGION 1..1134: note = Description of Unknown:uncultivated organism with predicted taxonomy: Fuerstiamarisgermanicae
  REGION 1..1134: note = MG4-249 effector
MADQLEQKPFILGIDLGTNSVGWALIRLEDGKPAGIIRAGARVFDAGMEGSAKDFESGGEKSRNLDRRRMRHQRRQTWRRARRMKKIFGLLQKFGLLPEGRCATPEDRQNFINELDRTIRASPWFQKKHPVCSKQNSELTKDEREEAHRLSQLLPYILRASALSEKLEPYILGRALYNLAQRRGFQSNRKQVAGKKEEDEEKGKVKPAIKALESKIEEQEARTLGSLLSGASPLKERIRGPQRWTGREMFRNEFDEIWKAQSHFHPELLTEDKRNELFDKDYPRHDPRVGAVFYQRPLKIQTHLVGFCELEPNLRRAPIHLLSSQRFRLLQKVNDLRIELPDSGERPLTPEERDKLVRILQDEGNQTVSDVKSKGVLNLRGCTFTLERNREKTIPGNRTAASFRKALGEKWEDMGSEERNDLVAKVYDIDDDESLKKAAVEQWHFTPQEAERLAQIKFEAKYLNLSETAVERLLPLMEIGFSYGSLAPYYSHLSSQEFLAKLFSALEEGVPHAEACRMVFGDLPVPAEAPKDVLPPVVEAFREIRNPAVTRSLTELRKVVNAIVRRYDKPAEIRIELGRELKKPKKRRELISKRNDENRSERETARREITEETGDPYPGKTDIRKVLLRRECGDQCVYCGEQFSGSNFFSDDAPIEIDHIIPRSLHWDDSFLNLALCHAKCNREKGDNTPAQVFSDEVIEQIRDRIRRFSGNEKTKRERFRRFTLAGAELSAYLEEFSRRQLQDTAYASKLAKRYLGLLYGGEIDNLGKRRVTATSGMVTWDLRGGWDLNGILNDGRTSNGSTVVKTRDDHRHHAVDAVVIALTDDRSIQQLNKAAAMGQMQGKRGIIKLPSTWNNFVDTVRAEIGRIIVSHRVSKKVSGALHEETIYSPPIAERGPDGKPNGEAVPHVRKPLFAITKGEIENIADDAVRQRVIARLEELGGGDPKKLFATEANLPFLVTRDGRHIPIKKVRVRKQLSPLVLGAGRVARHVVTEVNHHLEVFAYLDEKGNEYEWDGAVVSMAEAYRRTYSKPPLPPVQRNHGPETQYKFSLSPGEIIQCDPDNKGNSKLLVVRSVSQFETGTVQIGLAEINDARKKSDMTKDRKFIRVVPNKLRQWNARKVAVSPLGEVSEAND

SEQ ID NO: 649 - protein, 1097 aa, unidentified
  REGION 1..1097: note = Description of Unknown:uncultivated organism
  REGION 1..1097: note = MG4-250 effector
MADQLEQKPFVLGIDLGSNSVGWALIRLEDGKPAGIIRAGARAFDAGMKGSIESGREESRNVKRRQMRLQQRQTWRRARRLKKIFRLLQEFKLLPDGEASTPDKRQDLLEALDKNILASAWFKQKESAGSKHEARQVLPYLLRAAALDEKLEPHYLGRALYHLAQRRGFKSNRIQSSVKKKEDDEGPVKQEIKSLGNRMGEATLGQYFSGLSPFVQRIRTQKTLRDWYRKEFDLIWDKQAQHHPELQMTEKKKEELFHAIFDQRPLKDQSHLIGPCELEPGERRAPTYLLSSQRFRLLQKVNDLRVRVPEGSELELLAEDRTKLIQALEEKGNQTFVQVAKKLKLGEPEFNLQRGGEKKLPGDRTGSQFRKVFRKSWDQMTDEERDEKVSVVYDCLDDQKLVGIGEKEWSLDAKFAAKLTEIKFESSYLNLSRAAIGKLLTLMEAGFSYGSLAPFYRHLTPETTASLLSKVQEGMPPKLASQVVFAECINPAGEPKSLLPPVAMEIPWLRNPTVMRSLTELRKVVNAIIRQYGKKPEEIRIELAREMKKPKWRRKQISKRNRENETGRKQAKEEIKRETQNPYPSPYDIRKLILYKECRGQCVYCGAQISRSNLFGDNSDSEVDHIIPFSRLQEDSFTHVVLCHARCNAEKGNRTPSEAFTGEEHERILDRVSRFDNDEATRKAKLRHFTLAGEELANYLNDFSSRQLNDTAYASKLACQYLGVLYGGVEDSTGKKRVKASSGGVTGYLRRLWNLNRILNDGPTKSGGFIPKTRDDHRHHAVDAVVIGLTDESVVHKLSRAAERGFYRGRPFAPLEGLWPNFVPSIKTEIDRVVVSHRVSKKVSGALHEETIYSPSIPERGPDGKPNGEGIPHVRKPLAAITKGEIKDIADDAVRQRVQKRLQELGDGDPKKLFAIEANLPFLIAKDGRHIPIKRVRVKKKLPTFPLGSGRAERNVTTESNHHLEIFSKLDEDGNEVGWDGAVVSMLKVYSRKRLGLPIVQREHGPGTQFKFSLGAGEVVECDIAPGQRGLFVFRKVSRITATDQIQIGFAPLNDARKAKDMQTSRSWLWSGPNRLMERHARKFVVNPLGEVSEAHD

SEQ ID NO: 650 - protein, 1024 aa, unidentified
  REGION 1..1024: note = Description of Unknown:uncultivated organism
  REGION 1..1024: note = MG4-251 effector
MGLTTLGIDLGITSIGWGLITEDAAGIKLNGWGSRIFTPGMDDDIESGKGVSRCAQRRQKRALRIQYRRRRQRKDDLVDLLQRNDLLPTPLTPGFFIDMDKRFLMLFPVAERRVMGHLVPYLYRKKALDTKLEKFELGRTIFHLAQRRGYLSNRKQDLKDEETTGVVKAGIDALKSEMRKVGARTLGEYFCTVDPEKSRIRTRYTDRGMFQEEFRLICSAQRHLISPELEDELYKAIFFQRKLRSAKNLIGRCQIYPEERRCSYAKDEAQRFRIYSTLNHLRVAQKQQIRALTEAERAAAISVLEGFSGHLDRRGKITLAKLAKAVGLGKGEKFTLSDEEKDIHGNVLNAILYHVFGEKASSLTEKERALFFNDLNSIEKTEVLERRLRGFWQLPEDKAAEALKISLPDEYCAYSLRALHEMLPDLEAGIPLSQIRKLSYPTSTGVVYDRLPMLDGDEVDLDLRNPVVHRTLTELRAVVNAVIAKYGKPDRIRVELARDLKSSNKERERRTFEIRKREKARAEIAERIAREAQIEKPSRNDILKVMLADECNFTCPYTGKNFSMKELLYGKDIQIEHIIPYSRSFDDSFRNKTLCFSSANAKKNNRTPFEAFSGAEYEEILQRVGKFKWPFAEDKKDLFKCEKVDSEEFLARNLNDTRYASRLAVKYLGMLYGGVIDAAGKQRVFATTGGATAIVRRAWGANFLLGEGEKVRDDHRHHAIDALTIALTTPDIVKIIAGMPEELRRAKGKTPDDTIIDNAVFKQAKEMLDKAAVSHHIVNKLRGALHRETLYGKNRGGDMRHVRIGVDKLTVKDIPDIVDPVIKKLILERLEIDEDQISTITDKLLKKLVDTENPLFYRNKKGDVVNEIKAVRVKKHVTARTIGAGDGVREVANGANYLLAVFAVQDAQGNESSWEGEIVTLMDAVYRKQHDLPLFERERPGRKFKFTLKKGDIVKWNKDGVEQLCVIRGVSLPQFSCVPVCDARQQKELKNAKCWFTPTLSAAFAGKMTKYRMDILGELRRAND

SEQ ID NO: 651 - protein, 1033 aa, unidentified
  REGION 1..1033: note = Description of Unknown:uncultivated organism with predicted taxonomy: Bdellovibrioexovorus
  REGION 1..1033: note = MG4-252 effector
MRILGLDLGITSIGWALTEQPSASVTDVSEIKLVDWGSRIFEPGMAGTKNDIDTGKGVSRAVERRLARSLRHQYQRRRQRRKELIRIMTEAGFLPQELTPAFFIRMDAKLLSAFPKEDRRILGHVIPYLYRKMALNQDLSPEELGRAIYHLAQRRGYKSNRKKALKENEEEKGKVLQGIQTLKADMEAKGARTLGEYFCMLDPEEERIRGRYTERSMYEHEFHLICERQRELVSEELEKKLYKAIFFQRKLKSVKGLIGACQFEPDEKRCTFACEEAQLYRLYTSIDNLRIQKGGELRKLTDTERVAAIAILNGYSDKLDKSGKISLSALGKELHLLKGEKFTLGDEEKNIYGNALHAMLFYVFGEKSANMTPEEQSKFWHDLNSIEKEEVLQRRLASYWELNDEQVRKAMTLALPDDYCSLSLKALRTILPDLEAGIQLRKILELHYPENFRPSNNELAFLPAVDYSGIELRNPVVHRTLTELQKVVNAIIHRYGKPDYIRIELARDLKNTNKEKERITKQNREKEKERVKIIQQIIKEVGIASPTRNDILKVQLAEECGFECPYTGKHFSMAQLFDGNTIQIEHIIPFSRSFDDSYRNKTLCMATENGRKNNRTPYEAYAKEEYKAILTRVSHFKGPFRESKLQIFETKEFSPDDFLQRNLNDTRYASRLAMNYLGLLYGGAIDRNGKRRIQACSGGCTALIRRAWGANYLLGDGEKKREDHRHHAIDALTIAIITPEIVKTVANISKDEYKRRHMQNLPMLDDALYLQAEGKIDSATVSHHVVNKVRGALHNDTIYSKDGNQTYKRIRLDSISLKDIPKIRDKAIRTAVMKALGIDGDKTEAFMDSSLDPAKVFNDEHNLPWLTDKDGKNINRIKSVKVACNDKTRTIGSGDSRREVKPNDNYGLAIFAKIDANGQDKTWIYQVITLMDACQRLKKQLPIINKELQGFKFRFSLMKGDIVTITKDNHNTLCIVRAISEDEIVCTPVTDARQQKELKAAKVWFRLHPATALQLSLQKYQMNLFGDLRRAND

SEQ ID NO: 652 - protein, 1024 aa, unidentified; identical to SEQ ID NO: 650
  REGION 1..1024: note = Description of Unknown:uncultivated organism
  REGION 1..1024: note = MG4-253 effector

SEQ ID NO: 653 - protein, 1024 aa, unidentified
  REGION 1..1024: note = Description of Unknown:uncultivated organism
  REGION 1..1024: note = MG4-254 effector
MAQTTLGLDLGVASIGWALIREDGTKTTLDGWGSRIFKPGAEDDASDGKGLSLCAIRRQKKALRVQYRRRRKRKDELIRLLQENHLLPDPLTPSFFVNVDRQYLMIFPEEQRKTVGHVIPYLYRRKALDTPLSKEELGRTLYHLAQRRGYLSNRKKDLKDEEESGKVAAGIDTLKKEMEKSGARTLGEYFCLVDPEESRIRTRYTDRAMYQDEFRKICQAQRHLISAELENLLFHVIFFQNKLKSYKHLIGACSVYPEEKRCSYACEEAQIFRIYTTLNHLRIAKADQIRSLTGDEREKVFALLNGFSDLLTRKGSITLRNLGKAIGLGKGEKFTLSDDEKEIYGNVLHAILFSLFGTRAESLSQEEREKFFNDLNSIEKTEVLRRRLKSYWQLPDEKIAAAEKIPVPDDYCAYSLKALKEILPDLAEGIPLATILKLKHPMQAKDEMDQLPILDSDEADIELRNPNVHRVLTELRILINAIIVRYGKPDRIRIELARDLKSSAKERERRMWEMRQREKERTAIAGKIAEEAGIENPSRNDILKVMLAEECGYECPYTGKHFSMRDLLHGKDIHIEHIIPYSRSFDDSYRNKTLCLASANAAKNNRTPFEAFSGKEYQDILQRVARFRGPFAEAKLALFKLEKVEPEEFLERNLNDTRYASRLAMQYLALLYGGIIDKTGKQRIFATSGSCTAMIRRAWGGNYLLGEGEKVRDDHRHHAIDALTIALTTPEMIKVIASMTREERSRKQKSCNDTIIDNEIFRQASADLDNIPVSHHVVNKIRGALHDENPCGKDYGEQIRHKRIELSKLKADSVLKIVDRTVKNIILKRIGCSEKELAGLSEKEFAKRLDAGTPLLFKDKEGGTVNVIKKVRIKAKVTAKTIGSGDSLRNVANGSNYLLAIFAVLDEQGNETAWEGEIVSLMDARYRLTHKMPLFEKDRPGRKFKFTLKKGDIVKFRKDGTEYLCIIRGVSLPQFSCCPVKDARMQRDLKAAKVWFTPTVSAAFQGTMTKYRMNIFGELQRAND

SEQ ID NO: 654 - protein, 1024 aa, unidentified; identical to SEQ ID NO: 650
  REGION 1..1024: note = Description of Unknown:uncultivated organism
  REGION 1..1024: note = MG4-255 effector

SEQ ID NO: 655 - protein, 1024 aa, unidentified; identical to SEQ ID NO: 650
  REGION 1..1024: note = Description of Unknown:uncultivated organism
  REGION 1..1024: note = MG4-256 effector

SEQ ID NO: 656 - protein, 974 aa, unidentified
  REGION 1..974: note = Description of Unknown:uncultivated organism with predicted taxonomy: Planctomycetes
  REGION 1..974: note = MG4-257 effector
VESTGLILGLDIGVRSVGWALLDLKAKEIKGLGVRVFDAGVEGNVERGRDTSKAAARREARLRRRQTERQVRKQVKLAHILQDAGLLPEGKVSKPTERHQLLSVLDRQIGESYSSADRGKLPYILRAAALHVALEPFELGRALYHLAQRRGYKSNRKSDAKVDEKQGKVKPAIHELEKKIISVGAETLGEYLAMQDSPKVALRGPGQYTSRDMYLAEFEAIWSEQAKYYPALLTEKLKANVSDAIFFQRPLKSQAHLVGKCQLETGEKRAPWALPIAQRYRMLQTVNSLKVLAADGKARELSASERAKLLEKLECSKKQSFDEIRKCLKLGDDCSFNLEQLGRKEIPGNKTAALLATAFTKKRWASIPEKDKQRIYAVFNSEEDEDKLILIAQDEWKLDEKQARKIAGVSAEAGYCRFSEKALFRLIPYLEAGSDLESAIHKEYPGSRVASEKRDILPPVLSTVQLRSPAVTRALTEVRKVVNAIVHEYGLPETIRIELARDIKRNREERQNINKKISERTKEREAARTRLQEDFNLADPKSSDIEKYLLWQESGPKCPYCGNPIAGEVLFSGATHIDHIIPRKVSLDNSFVNKVLCCSKCNNDKSDRTPHEAFNGDTQRWEKIAERVGAFRSEYRREKLRRVLMTKKEAQEFYTGFTDSQLNDTKFASREAGDYLGLLYGGRVDADGNTRVQMTKGGITSELRNALQLGSIPSQVEDWICDPEEKRGKDRGDHRHHAIDAIAIALSSPGIIKPLMGAYSSSETAKKEMRRDIWASFAKKAAWPGFSDNVVEAVNSISISRRPKHRVRGKLFDENPLSEKGAARKSGDISEAYIRIGKDEAHSRLLKSAGNHHIEIYETKDAKGRPEWKGKAVTLYEAHNRIIDDEPVVNRHHGPNTRFLFSLAVGDTIELGEKQERKLYNVCSVWEDEPGSCRIEYKPLNSATTDRGVNARLNPIRKLKCKKVEVSPLGEHGS

SEQ ID NO: 657 - protein, 831 aa, unidentified
  REGION 1..831: note = Description of Unknown:uncultivated organism
  REGION 1..831: note = MG4-258 effector
MHSYVLGLDLGSASIGWAILEPNKKVIDCGVRIFDPGVNLEMFNKGQEGSSNNLVRRMARLHRRQLRRRAARQRDLFELLQQHSLLPGNATRDSQQRHDILQHLDSDLRAAWMNRLTAAGVPEQSLIYLVRKQALDAPLEPYEVGRVLYQLAQRRGFKSNRREQAAVEAAEGSKKKSVRAKDEASVVKDGIKELRAEMEAAGARTLGEHFANLSTSGQTIRRHWTDRKWFEAEFEAIWQAQAPHHAALIPELKQQVFQLLFFQRPIATNAHLIGKCELEPTERRAPMANLLAQRFRYLQKLNDLAIDDPLNPQRLTEEQRAVLLSAFECKPDLTFDAIRKLLSFDKAVRFNLERGGEKKLPGNRTNAAMLRAIPDLWPTLSDADKGAIVEQWIDANDDEDLIARLTTHCALSLDDATAICKVHPEDRYHNVSLLAMSRLLPLMEQGVAFKTAENEIYGTRFSGGKPLDLLPPAKDVLASIPNPAVMRALSELRKVVNAIVQKHGKPGQVRIELARDLKRNAKQREMNWRRGRDRETVRTAAVKRILDEAHRPQPWKQDVDRVLLLEECRDLCVYCGQAISFQRLFDGDIDIDHILPRNRFPDDSFANRCLAHRACNQLKLGRTPYEAFGSDEELWPNIIARVKTWDNPDKLERFNLRDDGEFDPEREDSFAARRLNDTRYVSKLAARYVGMLYGGRDVPQPDGAAKRVVFASTGMLTASLRRTWGLEAILREPEPAETSRKPGKQRTDNRHHAIDAIVIALTSNAVIQKASSVAATGSYGDAARAISRVQPPWGDFVGDFVDSIRPAIERMVVSHRPSHKLLGALHEETNY

SEQ ID NO: 658 - protein, 1073 aa, unidentified
  REGION 1..1073: note = Description of Unknown:uncultivated organism with predicted taxonomy: Acidobacteria
  REGION 1..1073: note = MG4-259 effector
MPLRADLPPYVLGLDLGSASLGWALIAIDHQHNPTALIRAGVRIFQPGVEGSAFDIERGKDKSRAADRRTARLHRRQLRRRAARQRDLFNLLQAHALLPGASDGASSSERRHTLLNELDKQLTDCLLRTAADDALAANRIADSLPYQLRKAALDRRLEPHELGRVLYHLIQRRGFKSNRREGKKSKDKQEEQGKVKAGISELQQKIAAAGARTLGEYFAGLDPHQQKIRRLWTARSMFEEEFEQIWRTQEAYAPDLLTQDLKSQIGYLLFYQRPIASQEHLIGRCELEPGEPRAPWATLEAQEFRVLQKVNDLAIVIPGSLHDQSLTREQREKVYLALQDTGDQKFSALRKLFELPRVQFNLERGGEKTLRGNRTHAHMFSVFGARWNEFSTDEKKRAVQVWRTAEDPGDLIAKGMEEFGLEEALARRWADVEPEDGYCSLSLKAIGELLPQMREGVSFKTVEREKYGEPFSGQEPQELLPRIREALPTLRNPAVERAVTEMRNVVNAIIREYGKPYEIRLEMARELRKSRKERENVTKRNRSRERERQQAKARILQECGLQNPSRADIEKALLFEECGGVCPYTGRTIEFSSLFRDSQFDVEHIIPLSRYPDDSFLNKTLCYHEENRSVKRGRTPWEAYGPDSERWDAILSRVQGFNNPAKLTRFKLRTEEELGEFTQRQMNDTRYTTRLAADLLGSLYGGRDETLPDGAKRRAIFATTGQVTATLRRVWNLESILREALPSANGESKGKPRTDHRHHAIDAIVVALTSQRTVQLLSMAAAQSVAGESRSRVFTGIQSPWPNFVDSIRPHIEQMIVSHRPEHKMSGELHDETNYGRPYRDGKKTYVHIRKPIASLSTKDIQAIVDPIVRTAVQKKAEALGGDLSKCEVSQNWPVMPTNKERAVPIRSTRIRKVLDVTAIGEGPRQRFVAESSNHHVEVFASLDAQGRESKWESITVSLLEASERNRKKQKVVQRLYPESEDYTFKFSLMGGDSVDLHRNCDHNLGRCNPALYRVRTIAANGQLSLVKITDARLKQDIQKVSEWWSPMCNALRKLDCRKVVVDLLGRVHPAND

SEQ ID NO: 659 - protein, 815 aa, unidentified
  REGION 1..815: note = Description of Unknown:uncultivated organism with predicted taxonomy: Planctomycetesbacterium
  REGION 1..815: note = MG4-260 effector
KHLLFYQRPIKAQSHLIGGCELEPGERRAPWASLEAQQFRILQKVNDLETILPGNVTGIRLTPEQRKTVLNLLENSPEATFKKIRKALDLAENIGFNLQRGGETRLKGNLTNARMAEAFSDRWPTMSDEEKKQVVEDWRTIEQNESFMRRAIEYWKLDEAGADWLADQSAPQGYCSISRKAIRRLLPLMMEGKRFKEAETEVYGNRLTGGKVYDRIPPVRDVLRTLRNPAVERSLTELRKVVNALVREHGKPAEVRIELARDLKKPRHERAEAITKNRNREKERVAAKTKLLQELGPGFEHPSRADVEKALLHEECGGVCPYTGRHIEFASLFGENPQFDVEHIIPFSRIPDDSFQNKTLCYHEENRLVKRNMTPFEVYKDPAQYEAILNRVRTWKKLNPGKQRRFELRTLEELEGFSARQLNDTRYASKLACELVGSLFGGRDAQTENGSRQIVFASSGMVTATLRKGWGLEAILREAAPSANGQNRGKPRTDHRHHAIDAITIALSRPKMIATLSRNNAQDPYWPQNGRTAPRIQSPWKDFVGSIRPHFEQMLVSHRPEHRLTGALHDETNYGRPRKDGSKDVVHIRKQVAGLSAGDIENIVDPAVRDAVCTKAREFGGDLKKWTPNEDKEDWPLLVTRTGKPIPIKRVRIKKALRVETIAKGERVRHVALSSNHHVAIFALLDERGREKRWESEIVSLLTAMERKRNRQPVIRTRLPEVPEAAFKFSLMWGDILLLHKDCEHSKNICNPSFWRIRSIWEQGTLTLVRINDARLLTEIRAAKDWLLPSPDTLRKLGAVKVVIDSLGRIHQAGG

SEQ ID NO: 660 - protein, 911 aa, unidentified
  REGION 1..911: note = Description of Unknown:uncultivated organism
  REGION 1..911: note = MG4-261 effector
NRIGHVLPYLLRKTALDRPLDKYDLGRALYHLAQRRGYLSNRKQELKDSEDFGVVKSKINELRQAMTSSGARTLGEYFSMVNPEEERIRCRYTDRAMYQDEFRKICNAQRQHISEALETELFQVIFFQRKLKSCKHLIGKCQVYPEQKRCSLCHPEAQLFRICTTVNNLRISCDSQIRSLTDDERLRVTEVLNGFSDLFNKSGKITLAKLKQATGLLSSEKFTFGDDEKEIYGNELHNILYRAFGSEAALMSQEKQSCFINDLRSIEKNEVLKKRLTEYWQLSEEKASEVATIKLPDDYCAYSLKALKQMLPDLQAGVNLADWLKCNNHSTESYIELDQLPLVDECGFELRNPVVHRVLTELRRVVNSIISRYGKPDLIHIELARDLKASNKEREQITKRNQQRERERNAIAERIIKETGLEKISRKDILKVMLADECDFTCPYSGKRFSMTELLNGGLVEVEHIIPFSRSFDDSFANKTLCVRELNAKKNNRTPFEAFGGSPQYSEMLTRVKYFKGHFAEHKLNLFKLAEIESSGFLERNLNDTRYASKLSMRYLAFLYGGIVDKNSIRRIFSVAGGCTALIRRAWGGNYLLGEGEKVRDDHRHHAIDAVTVALTTPELVQKIAKLSQEGRRKLNDSTKNFIDNDFYYQAQGMMDSCAVSHHQTNKMRGALHEETIYSKDYGDGQSIRHKRIALDQLSPKDIENIVDPAVKTIILKALKVSAPGDVTKATLKIFKDEANYPQMLDHNGNAVNTIKKVRIARTVNTRTIGKGDGKREVANGANYILAIFAKLNEKGEETGWEGEVVSLMDAVQRKQRRQEIFSKERPGMKFKFSLQKGDIVKINKNGEEKLCRIRGISLPQFYCCQISDARTQNDLKSAGCWYTPTVSAAFNWKMQKYNMNIFGELQTAND

SEQ ID NO: 661 - protein, 1002 aa, unidentified
  REGION 1..1002: note = Description of Unknown:uncultivated organism with predicted taxonomy: Planctomycetes
  REGION 1..1002: note = MG6-7 effector
MSEITLGLDIGSNSIGWALLNLDENPSIINVGVRVFQEGVNRDTKGAEISKNETRRMARGARRNRFRRNYRKDKLLRLMKRNGLLPKEASTNGEIFLLNPYQLRAKGLDEKLSLHEFGRVLYHLNQRRGFLSNRKSGKAKDDGIVIKSAGELQQKMDAQGARTLGEYFSRIDITQERIRDNYTFRGMYQKEFDLLWEKQSSFYPEILTPELRQTIADETIFYQRPLKPTDELIGDCALEPDHKRCPRGDWHARRFRILQDVNNLMVCEPDGRKRILTEQERSIALKELFGRKEVGFDSLRKKLGLIENQTFNFEEGSLDKKESKLKGDFFASEMSSKKILGKKGWEALDIATQIEINDLLLDDNLADEEVVEMLKQQYGFSDEQAEAAIKISLPRGYMTYSRLAIQKLLPHLERELRTDEAVQAAYGHIHSVQDTGQTVDFLPLPEDLRNPIVNKALIEARKVINAVIQTYGKPGKIVVEMARDVKGNAKEREELRIKMNRNEKENERARHELIHNMGITRPTRDDILKYKLWQECGRECPYTGRPISQQALFGEHPEFQIEHIIPYSRCLDDSFMNKTLCYVDENRRKGDQTPYEFYKNSDQYEHMLQRIRKLPYPKRQKFTQKEVSLDEFIKRQLNDTRYITREILRYLKQLGCTVTGSRGKVTSELRHQWGLNSILESDLPGPKNREDHRHHAIDAVVTALTNQKHLHELAATKYAVAHDGFPVPWEGFRDAVAQAVNKIQVSHRVTRKVSGPLHEETSYGPTGLKDDKGQDIFVYRKKLEALTCPMVEKIVDPVVKEVVKTRLLEFGIDPKKKGSIPKEVWAEPLYMKSTKSAKVPIKKVRIRDVFNNMIPVNDEIGKPYRYVASGNNHHIEIFEYTDAKGNLKRNGKVISMFEAVQRSRQGKPVIYRDYGDGKRFVCSLAKNEMFMLEVEEGRHILHRVQKFGEVGGTIIIVLRPHTFAGKVNDSDKPPYIQRKTPNTLKGYKVTIDPLGRIFPAKD

SEQ ID NO: 662 - protein, 994 aa, unidentified
  REGION 1..994: note = Description of Unknown:uncultivated organism with predicted taxonomy: Planctomycetesbacterium
  REGION 1..994: note = MG6-8 effector
MSDYTLGLDMGSNSIGWALLDTNNRAVVDAGVRVFQEGVDRDTKGAEVSKNETRRTARSARRARKRRNYRKDKLFRMLIRHGLLPKGPDELKEVFELDPYLLRAKGLDEKLDAYEFGRVLYHLNQRRGFWSNRKSGKSKEDGVVVKSATALAEAMDESRSRTIGEYFAGVDSHEKRIRGHYTFRSMYEEEFEALWTKQASFDGELFTDGLKKAIKDETIFFQRPLRWDPETIGDCELEPGEKRCPRADWHARRFRILQTVNNLKLYNPDGREGDLSKYRETIIGELCNRKEVYFDSLRRKLGLIDSQTFNFEEGAAEKKAKLKGDEFVPQLKKAIGAKALKGLEEADIIEINDALIDDNIEDEELVEKLMEQYGFSEEQANGVVNISLPSKYTNFSRLALQKLLPKMEAGLRTDEAIEAVYGKRQAVGEIEKRRRLGSVPDLRNPIVMKALWEVRKVVNGLVREYGIPRKIKIEMARDVKGSVKERDEIRVKQWKNEQENKRAEEELKLMGIRNPSFNDRLKYKLWEECGKECPYTGKPISQHQLFGEHPDIQIEHILPYSRTLDDSYMNKTLCYVNENRLKGNETPYEYYAENRVEQWEEILQRIKVLPYAKRRRFWQKEVVLDNFIQRQLNDTRYISREVVKYLKQLGCIVTGTKGQITSELRHQWGLNNILDYTGAGLKNRDDHRHHAVDAVVTAVTEQKHLGGLAASKYDKSGIEFDPPWEGFREQVAEKINAINVSHRVTRKVSGQLHEETSYGPTGLKDDKGQDIFVYRKPLEALTLPMAAKIVDPVVREIVYERLREFGIDPDGKSKIGKEVWKEPLYMKSKSGKGPQIKKVRIRDVFNNMIYIKDDAGKEYRAVAPGNNHHIEIFEYANKKGRIKRDGKVVTMYEAVRRSVNNKQVIRRDYMDDKKFVCSLSKNEMFMLEVEDGVHVLHRVQKLIQDGRIVLRPHTYAGKVSDSDNPPLVQRKNYNTLRGYKVTVDPIGRIHRAND

SEQ ID NO: 663 - protein, 896 aa, unidentified
  REGION 1..896: note = Description of Unknown:uncultivated organism
  REGION 1..896: note = MG6-9 effector
LNEKLELFEFGRAIYHINQRRGFKSNRKTGKAKEDGKVAKAAGELQKKIEANGCRTLGEYFASINPEEERIREQYTFRTMYEEEFDKLWNRQAEFYKNVLNGDLHKKIRDEIIFYQRPLKPTDDLIGDCELEAGEKRCPRGDWYARRFRLLQDVNNLKVYNPDGTARELEDDESGIILKKLATHKEVKFSSLRKELGLLKTQEFNAEYQIDNKGKKQEKLKGDAFNASMRSKNIFGAKTWDAMDEAEKIKLNEWLVDLDDDELIEKLSSEYGLRDEQIDRVLKISLPQRYMNFSRKAIQKLLSLMEKGKRTDEALAEIYPDRNKRAKGEEKDRLDLPDDLRNPLVNRGLFEVRKLVNAVIREHGKPSGIVIEMARDVKGSLKEREEIQWKMRENEKRNEAARTRLIQDMDILNPSRDDVIKYKLWEECGKRCPYTGKVISLTDLFGSNPVFQVEHILPYSRSLDDSYMNKTLCCVNENRIKGNKTPYEFYSGDEEKYEQVKQQIKVLPWPKRRRFLQKEIKLDECIQREMNDTRYICKEVVKYLKQLGVNVRGSKGRVTAELRHQWGLNSILDLNNSNMKNRDDHRHHAIDAVVTAVTKNEHLRRLAKSKYSKTDSSFSEPWEDFREELAEKVKHINVSHRVRRKVSGKLHEDTSYGLTGAKDDKGQEIFVYRKKIEDLTIPMVSKIADHVVRQIIESRLKKHGIDLDKNQTIPKDVWTKPLYMKNTKSNKKVLIKKVRIRDAFNNMIFLKDKEGKTYRAVAPGSNHHIEIFEYTDKKGKMMRGGEIVTMFEAVKRKREDQPVIKRECGADKKFICSLAMNEMFMLDTNNKEKELHRVQKITQSGNSISIILRPHSYAGKVSDYDKPPIIQRRSPNTLKGHKVTVDMLGRVHLAND

SEQ ID NO: 664 - protein, 996 aa, unidentified
  REGION 1..996: note = Description of Unknown:uncultivated organism with predicted taxonomy: Planctomycetesbacterium
  REGION 1..996: note = MG6-10 effector
MSKYTLGLDIGSNSIGWALLDTGKSPKIIDLGVRVFPEGVDRDTKGAELSKNATRREARGARRNRWRRAYRKDKLVRMLQREGLLPREFDLIQKLMETNPYLLRAKGLDEQLGLHDFGRVLFHINQRRGFKSNRKTGKASDNNKVAKEAGQLQEAIDNTGCRTLGEYYANLNPEKNRIRSQYTFRSMYEKEFALLWAKQSEFYPEILTEQLKEEIKDKTVFYQRPLKPTDDLIGECDLEEGEKRCPRGDWYARKFRLLQDVNNLKIHHSDGSEDPLTDEQRAIVLEQLKKSKAVKFSSLRKKLGLLETDEFNMEYEVNEKGKKKDKIQGDEFNASMQKNIFGLKRWGEMAEGEKIRLNEWLVDLEDDELIEKLASEYGFSDEQTEKVLKISLPSRYMSFSQKAIKKLLPLMEEGKRTDEALDKIYPDRNQKKQVEAERLGLPEDLRNPLVNKALFEVRKVVNAVIREYGKPAKIAIEMARDLKGSLRERKEIHFKQKENERENKRVRERLKNDFNHVSLNRDNIIKYKLWEECNGLCPYTGKKIPQYALFGENPEFQIEHILPYSRSLDDSYMNKTLCEVHENISVKGNQTPYEAYHHDEEKYEQIKQRIKVLPWPKRRKFLQKEIELDEAITRELNDTRYICREAVRYLKQICSNVKGTRGKITSELRHQWGLNSILNLTDPNMKNRDDHRHHAIDAAVVAVTRNKHLRELAESKYAKTGSGVKFEAPWKDFREELAEKIKHINVSHRVTRKVSGQLHEETAYGPTGLKDDKGQDIFVYRKKLEDFTMPMVGRIVDPVVKEIVVDRLKKHGLNPEKKQTIPKEVWREPLYMKSKTGNGPRIKKVRIRDVFNNMIMLKDQNGKPYRAVAPGNNHHIEIFEYKDKDGNIKRDSKVVSMFEAVRRRRKGEPVIQRDHGEGKKFICSLSTNEMVMMPDKEGNNDLFRVQKMSINKQIYFRHHTAATIDNEETLIRKQANLFNGKKVAVDPIGRVFPAND

SEQ ID NO: 665 - protein, 994 aa, unidentified; identical to SEQ ID NO: 662
  REGION 1..994: note = Description of Unknown:uncultivated organism with predicted taxonomy: Planctomycetesbacterium
  REGION 1..994: note = MG6-11 effector

SEQ ID NO: 666 - protein, 896 aa, unidentified; identical to SEQ ID NO: 663
  REGION 1..896: note = Description of Unknown:uncultivated organism
  REGION 1..896: note = MG6-12 effector

SEQ ID NO: 667 - protein, 996 aa, unidentified; identical to SEQ ID NO: 664
  REGION 1..996: note = Description of Unknown:uncultivated organism with predicted taxonomy: Planctomycetesbacterium
  REGION 1..996: note = MG6-13 effector

SEQ ID NO: 668 - protein, 1063 aa, unidentified
  REGION 1..1063: note = Description of Unknown:uncultivated organism
  REGION 1..1063: note = MG6-20 effector
EAFDEANPYTLRKMALYGPLTSEQFGRVLFQQGKRRGLKSNRKAERKADDGDVNRATKRLEAKIADDDCQTLGERLYRIGAGQIADSQNVKPGDLNPHRIRGRYTLRKMYEEEFEKLWNKQEQHIPELRAEGLKSRIRRIIFDQRALRSSKHLIGRCECTGQRRAAKADWYAQEFRLLKDLNHLRIHNSDGSEQDLKKEQRLRLAELLRCTDRLTFDEMRQELGLIDSQIFNLEEGPSATVGQTNEGKKSKVRAGAKRKSLAGNSIESALWKAFGKNWALQTEVRKDEIRQAIVEIEDEEKLMRLAVGLWGLKRTQAEALAKLHLPEGYAKYSLDALKNLVAELRKGLKSERGIAEYEARERCGYNSPVTQSLLDFLPSPVKPDRRPLVNNPIVRQSLFEVRKVVNAIIRQYGRPKRVVVEMIREIKGSLRQRAEIRDQQEASRKDREEIRTMLRDPIEFGKDNPSNDDILAYRLWEQQGHLSPYSGKTICQTDLRRFLNGEGVLEIDHILPYSKSWDNSQSNKCLCFSDENKNKKDFTPRQWLGDGTDAYTSMLQYVAGMKTTGMPFSKRRKFSQLEVDPEDCAKRQLNDTAYIAREVRQYLKCLYSEEELVRDESVVCTRGQVTSDLCWCWELNSILNPDDQRETKNRADLRHHAIDAIVVALTTRQRLFALSQVFAKKHSLAKAKHEPWPHFREDVENAVLAIKVSHRPRKRVSGPLHNDTIYGATDEDGRFVSRKFLTDLTPTMVSRIRDARVREAVVERLRKHGIKAKGADSIRDVGPEETPGDSDKRIPKKIWEEPLILVRKDCTEGPRPTPIMKVRLIGPEKTIRPIRNGAALVKPASTHHLSLFEIRKSNGDPEWIAHFVHLIDAAQIVGERQRRFSMIRKQLGAARLPSSEIKRRLELEQCRLDIELPLIVKTHPDIPSARFLFSLSKGEMLLLSIKGKEQLYRFETAASTTEQMWFLKHNEAAIPKNKRLSKKPDNLRGLKPRKVILDPLGRDVSGTGKVYDRVDSKVGDLAKEIIANGMSNSRGHKLLKQMGLGQLGAQLTAELRRLRSGGL

SEQ ID NO: 669 - protein, 1121 aa, unidentified
  REGION 1..1121: note = Description of Unknown:uncultivated organism with predicted taxonomy: Arcicellaaurantiaca
  REGION 1..1121: note = MG7-2 effector
MKKIVGLDIGVSSIGWSYVLESEIETDEETEDIIELGSRIIPLSNDDADQFSKGQSITKNKERTQKRTARKTNNRYKLRKHKLGEVLKNQEIIINPELFDLTAYELYALRVRAIHEPITLAELARLWYQFNQKRGYQSLRGVVDEEADKKSDYLSSINDRSQFLKDNKQTVGQFLFNRLKDYEQNRGVIEPITHIIFNRQDYFNEFNLIWERQKMEYPEVLTDELLANIRDRIIFYQRPLMSQKHLVSDCTFEKNHKAAPKSSPLFQVFKIWQDLNHFEIKTKRGAIVAFTVEMKQKVFEVLDNQFDINKTKFWEILELKASEHRLNFKEIRGNVSKAKLVEAFAELDINRPDLLSFDPHGDPDEQPLFRIWHLLYSINEKNADEILLRTLQNTPYNFSEKEAIGLIQKVSFKNDFGSLSSRAMRKILPHLEQGLNYADACLEVGNRHSHYRTKEENNERVLADKLLPLPKNSLRQPVVEKIVNQVINVMNAILADSNLGRPDEIRIELARELKQNIKQRERTERNNNKRQKARKDVVKEILKTFPDMKEKDVTNRMIQKYELFQETNGICVYTGTEMKLGAVLSGQGFDIEHIIPKSRRFDDSFMNKTLADSSTNRDKNDLTAYDFMRKKGMTSFEKFTEIIHKLHKDKKISDTKLDNLLTTLNPVWIAEQEAKALSTDFINRQLNETQYITKQVKAELDKICRTITVTSGGITDYLRHQWGVDDVLKNINLEKYEAAGKVSDEDYRDRQGHWRTRKKIADWSKRDDHRHHAIDALVIACTKPAYIKRLNDLNQEYDSYKEMKKDGGKMESLTKFPQPKMKGGFIQNVTKATENILISFKAGKKAVSTSKNKKTGQVNIIPRGQLHEETVYGQKFDESGKPYFVIRKKLEFNKQGYFNSLAQIDKIEDEIIKKKVLKRIDEYGGDLQKALSTVIYHNEDQKIPIKKVMIQAQIKKAVPLGNHEGKFVAEGNNHHLALYRNEKGKYLTELVSVWTAVVRKQNDLDIICRNHPEGLKFITCFQQNEMFIYELSPEQVQEAIDRKDRKLLSKYLYRMQKISKKESGGIEVGFRHHLETKIDDSETAKKIKKFFIVQGVETLLKFTKVKINHLGQITKIFAEGE

SEQ ID NO: 670 - protein, 781 aa, unidentified
  REGION 1..781: note = Description of Unknown:uncultivated organism with predicted taxonomy:Flavobacteriales
  REGION 1..781: note = MG7-5 effector
MKKIVGLDIGVSSIGWSYVLESEIETDEETEDVIAMGSRIIPLSQKDTDEFSKGDSITKHKARTQKRTARKTNNRYKLRKHQLGEVLNNQGIIINPELFGLTARELYALRVRAVHEPITLSELARLWYQFNQKRGYQSLRGVVDEEADKKSDYLSSINERSQFLKDNKQTVGQFLFNRLQDYEQNRGVIEPITHIIFNRQDYFNEFNQIWERQKLEYPEILTDELLANIRDRIIFYQRPLMSQKHLVSDCTFEKNHKAAPKSSPLFQVFKIWKDLNHFEIKTKRGAIVEFTVEMKQKVFGVLDNQFDINKTKLWEILGLKASEHRLNFKEIRGNVTKAKLVEAFTELNINRPDLLSFDPHGNPDEQPLFRIWHLLYSINEKNADEILLKTLQNAPYSFTEKEAIGLIQKVSFKNDFGSLSSRAMRKILPHLEQGLPYDKACLEVGIRHSHYRTKEENNERILADKLLPLPKNSLRQPVVEKIVNQVINVMNAILADPNLGRPDEIRIELARELKQNIKQRERTESNNNKRQKARKDVVKEILKTFPDMKEKEVTQRMIQKYELFQETNGICVYTGTEMKLGAVLAGQGYDIEHIIPKSRRFDDSFMNKTLADSSTNRDKNDLTAYDFMRNKGMTAFEKFTEIIHTLHKNKKISDAKLDNLLTTLNPVWIAEKEAKELSTDFISRQLKETQYITKQVKAELDKICRKITVTSGGITDYLRHQWGVDDVLKNINLEKYEAAGKVHDEEYRDRQGHWRTRKKIADWSKREDHRHHAIDALGIAC

SEQ ID NO: 671 - protein, 774 aa, unidentified
  REGION 1..774: note = Description of Unknown:uncultivated organism with predicted taxonomy: Arcicellaaurantiaca
  REGION 1..774: note = MG7-6 effector
MKKIVGLDIGVSSIGCSYVLESKIETDEEIEDVIAMGSRIIPLSKEDTDEFSKGQTITKHKARTQKRTARKTNNRYKLRKHQLGEVLNNQGIIINPELFGLTARELYALRVRAIHEPVTLSELARLWYQFNQKRGYQSLRGVVDEEADKKSDYLSSINERSQFLKDNKQTVGQFLFNRLQDYEQNRGVIEPITHIIFNRQDYFNEFNQIWERQKTEYPDILTDELLANIRDRIIFYQRPLMSQKHLVSDCTFEKNHKAAPKSSPLFQVFKIWQDLNHFEIKTKRGAIVDFTVEMKQKVFEILDNQFDINKTKFWEILGLKASEHRLNFKEIRGNVTKAKLVEAFSELNINRPDLLLFDPHGDPDEQPLFRIWHLLYSINEKNADEILLKTLQNAPYSFTEKEAIGLIQKVSFKNDFGSLSSRAMRKILSHLEKSLNYADACLEVGNRHSHYRTKEENDERILADKLLPLPKNSLRQPVVEKIVNQVINVMNAILADPNLGRPNEIRIELARELKQNIKQRERTESNNNKRQKARKDVVKEILKTFPDMKEKEVTQRMIQKYELFQETNGICIYTGTEMKLGAVLSGQGYDIEHIIPKSRRFDDSFMNKTLADSSTNRDKNDLTAYDFMRNKGTTAFEKFTEIIHKLHKDKKISDTKLDNLLTTLNPVWIAEQEAKALSTDFISRQLNETQYITKQVKAELDKICKKITVTSGGITDYLRHQWGVDDVLKNINLEKYEAAEKVHDEEYRDRQGHWRTRKKIADWSKRDDHRHHAI

SEQ ID NO: 672 - protein, 1131 aa, unidentified
  REGION 1..1131: note = Description of Unknown:uncultivated organism
  REGION 1..1131: note = MG7-9 effector
MKKVLGLDLGIASIGWALIAQNSENEEISHIIDCGVRVVPLSTDEHSEFAKGGSVPTNQIRRRARGMRRNLQRYRWRRHRLYCVLGQLGMMPDQRLMTRLSPLELYSLRSRALSEPLSLQEIGRILIHLNNWRGYRSNRREAVKDDEKSRYLKEIKNNEDQLKVEDKTIGQFFAERLHQGDRQRIRGRIFGRNTYIDEFNRIWDAQAQYHPSVLTEEHRRLIRDRIIYYQRPLKSAKGLVGTCALEWYYALYKETRQPKYENGRKKIVRPKCAPKSSPLNQECKVWESIHNLRIYRRDRNGRRESQPIALTLEQKKHLFWYLQESKKNLKAEEALRLLGFSAGAYAVDDHTLENNRTLSRLKEVFKKLGIRRDDLLRFDPAIEEVEWDDLETGERRRRLQVRGDFDREPLYQLWHLIYATEDEGDLIQLLEERYGFTTEQAREIAKIDFTSEGYARKSHRALRRLLPHYREGLDYTKACEAAGYRHADYITKAENEARILSERLELLPKNALRNPVVEKILNQMVHLVNDLMTTYGRPDEVRVELARELKQSAQERKKTHELNQKRRRENERIKKDIADHLAIPPEKVTRAQIEKYRFYKEIDGISLYTGKRFSLADVLNGDTVDVEHIIPRTLRFDDSYHNKTLCERNINQEKGNMTACDYMRSRGAQEYEAYLERVKAFYEKNGREVRLKYKNLTTTQEDLLKDNEFLQRQLRESQYIARKAVEVLREVCRNVYTTTGSITDFLRHRWGWDEVIPYLRLPQFKEAGLTEIIPVQNGQKTKEVIKGWSKRDDHRHHALDALVVACTRQSHIQRINELSPILAGTYGEERRQQLLDIVRDKYIAGKIPFSFRQVCEAMNQVLVSHKQRTRVATRNCPKGSQKVQITLTPRGRLHEETIYGRIRRYKKVSLDGKFSVAMLDDMVHPHQRELVEARLAQYANNPKAAFKDLDKNPIRYGPNGEKHLREVTVWEYIMVSRKALDPKATGKALKGIIDPVVHQVVKQHFEAGNVGGLPFRHVRVENRAEEWIRLPRGYAEPGSNHHIAIYRDADGKKHEHVVTFWEAFQRVHIGLPPIITDVAGALEYLSHLPGELPELHLPENPDWQFVVSLARNDMFVFGLDPADIDLRDLKN

SEQ ID NO: 673 - protein, 1225 aa, unidentified
  REGION 1..1225: note = Description of Unknown:uncultivated organism with predicted taxonomy: Bacteroidetes
  REGION 1..1225: note = MG7-10 effector
MEKVLGLDLGVSSIGWAMTLQDPNNEERSEIIDCGVRIVPLDTDEIKEFGKGGNVPTNVARRQARGMRRNLQRYRWRRQQLFRALKQLGMLPDERLLRQLSPLQLYALRERALSEPLSLPEMGRVLIHLNQWRGYRSNRKEQTESDGKKPSEYLEQIEKNEERLQGQTIGQYFAARLRESGGYRIRQQLFSRETYKQEFDRIWEKQAEYHPQVLTEANRSWIRDRIIYWQRPLKSAKGLVGECALEWCYALDKNQQPIRLPNGQLKIVRPKCAPKSSPLVQVCNVWESIHNLRVYDHFGEERPLSQEEKERLFRILQDRSLTARQIIKDVLLLSPKTHTVDRLIQEKGLEYNRTRARLLEVFKEQKINREDLLEFNPVIEEVEWDNPETGERLRRLQVRGDFTQQPLYQLWHLLYATEDERNLVALLQKRYGFTEAQAKALAKLDFTSAGYARKSHRALRRLLPHYQRGLDYAAAAQAAGYRHANQMTKEENQARPLLDRLEVLPKNSLRNPVVEKVLNQLVHLVNDLIATYGRPDEIRIELARELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDGEFLQRQLRETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLRVATRSRNRPKGSTTVQITLTPRGALHEETVYGRIKRYKKVPLNGKFSPAMVTEIAHPHQRALVEARLAQHNGDPKKAFKDLEKHPITYGPNGSKHLTHVTVWDYVLVARKSVDASLSEKAVEKIADRGVRRAVAERLKAGGGKSKEAFKNVGTDPVQPPRHHPVKRVRVENYAEKAIRLPRGYVEPGSNHHIAIYRDADGNKHEHVVTFWDAFQRVRLGLPAIITDVPAALQYAQDQLPEGVTDLLLPEGWDWQFVVSLAQNDMFVFDLDPSEINFTDPNNRARISKHLFKVRKLSANDYSFLHHLETEIVDDLVSKSINRCKRCSMSALSRSRAVKVKINRLGHVVEVGQPFS

SEQ ID NO: 674 - protein, 1218 aa, unidentified
  REGION 1..1218: note = Description of Unknown:uncultivated organism with predicted taxonomy: Bacteroidetes
  REGION 1..1218: note = MG7-11 effector
MKKVLGLDIGVNSIGWAYIAEPENKNEKYNILGAGSRIIPLNSDETSEFKSGNAISKNSARRIKRGIRRGGHRYKMRKWKLTAKLKELGMFPDKELFSLHSLELYSLRTKAISEKISLQEIGRIFYHLNQKRGYKSNRKANNDENIEVNVSDKPGKKKGYLDLINDRENILTSQKITIGQYFYYKLKEQPFFRIKDNIFTRKSYQQEFKKIWDQQSIYYPNILTEEAFNILFNEIIYFQRPLKSQKHLVTDCRFEFVFAKNNKGELLKDDTGSLRKIKLKAAPKSSPLFQLAKVWQDINNLKIQDTYGNIIEITLEKKKLIADKLQETDKITLKELKKILGLSSKEEYYYNLKKEYIEGNRTFVQLKKILGDNPLLEFNVEINERSISDYNTGETEVRKVINSSIEQSPLYQLWHLLFAAEENENLISTLCKKYSLSPETALALSKLDMTKAGYGALSTKAYRKILPYLMEGSGYSDACQLAGYRHSDYLSKEENESRQLLAKLDLYPINSLRNPVVEKVINQVINLVNAILEDPAYGRPDEIRVELGRELKQNAEERNKTFSRNKKEDAKHKDIIHRLMTECNFKKVSRRDIERYKLWEEFGYVSPYEPSKPISLSELFSGAYEVEHIIPKSRLFDDSFANKTICPRPINAAKDNQTAFDYMSGLGQQKLDEFTDFIQKHKTKKDGISQTKAKYLLCKGSEIPQDFINRQMRETAYISREVKNLLLGICRNVHSTSGTVTNYLRHIWGLDSILQELNIEKYRACGQTVKEIIGSNGSTKENERIVNWSKRDDHRHHAIDAIVIALTKQSHIQKLNNLNQEFQNYRELKQSAYNFPLPWATVHSDVLRTVSNILVSFKSGKKVATKNINRIKKNGKVVKELPTLTPRGFLHKDKFYGKIKRYETVPLTPRFKEWDRIADNNIYNQLKERLSRYKDNTKLAFSENEKDPIPKSLQSITLFQEKFVIRQELNKDFNLARTENIIDERIKRIVKGRLSQNQGNPIKAFGDLENDPIWINKEKAIDIKAVRCFTDLKDLSSLHKNDKGENIHYVSTKNNHHIAIYEDQNGNLAFNAASFWDALNRKLHDLPVIIKDPKSLWNKVLEKGIDNQDVLSNLPPENCSFRTSLQQNEMFIFGMTREEIEDDIRNENYSRISKGLYRVQNISTGKGIDVFFRHHLETKLQDSNNDKEVGKFIRCRTLNSLSLIKVLINYTGSIYLYD

SEQ ID NO: 675 - protein, 1223 aa, unidentified
  REGION 1..1223: note = Description of Unknown:uncultivated organism with predicted taxonomy: Bacteroidetes
  REGION 1..1223: note = MG7-12 effector
MEKVLGLDLGVSSIGWAMTLQDPNNEERNEIIDCGVRIVPLDTDEIKEFGKGGNVPTNVARRQARGMRRNLQRYRWRRQQLFRALKQLGMLPDERLLRQLSPLQLYALRERALSEPLSLPEMGRVLIHLNQWRGYRSNRKEQTESDGKKPSEYLEQIEKNEERLQGQTIGQYFAARLRESGGYRIRQQLFSRETYKQEFDRIWEKQAEYHPQVLTEANRSWIRDRIIYWQRPLKSAKGLVGECALEWCYALDKNQQPIRLPNGQLKIVRPKCAPKSSPLVQVCNVWESIHNLRVYDHFGEERPLSQEEKERLFRILQDRSLTARQIIKDVLLLSPKTHTVDRLIQEKGLEYNRTRARLLEVFKEQKINREDLLEFNPVIEEVEWDNPETGERLRRLQVRGDFTQQPLYQLWHLLYATEDERNLVALLQKRYGFTEAQAKALAKLDFTSAGYARKSHRALRRLLPHYQRGLDYAAAAQAAGYRHANQMTKEENQARPLLDRLEVLPKNSLRNPVVEKVLNQLVHLVNDLIATYGRPDEIRIELARELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDEEFLQRQLRETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLRVATRSRNRPKGSTTVQITLTPRGALHEETVYGRIKRYKKVPLNGKFSPAMVTEIAHPHQRALVEARLAQHNGDPKKAFKDLEKHPITYGPNGSKHLTHVTVWDYVLVARKSVDASLSEKAVEKIADRGVRRAVAERLKAGGGKSKEAFKNVGTDPVQPPRHHPVKRVRVENYAEKAIRLPRGYVEPGSNHHIAIYRDADGNKHEHVVTFWDAFQRVRLGLPAIITDVPAALQYAQDQLPEGVTDLLLPEGWDWQFVVSLARNDMFVFDLDPSEIDFTDPNNRARISRHLFKLRKASKKQYWFLHHLETEVLEDLASKKAYRCKQCSMESLAGAVKVKINRLGHVVEVGQPFS

SEQ ID NO: 676 - protein, 1134 aa, unidentified
  REGION 1..1134: note = Description of Unknown:uncultivated organism with predicted taxonomy:Deltaproteobacteria bacterium
  REGION 1..1134: note = MG7-13 effector
MKKILGLDIGTNSIGWALITEPENGESGEPEILRCGVKVIAMDQKQINAFEGGQALSANQERRLKRQMRRNNWRYKLRREALVARLVELGWFPREWKDDLQARHEALKLHDARYIYGLRDKAARGERITLRELGLIWYHLNQKRGYKSNRKAQDEEESNDSVLLSQIAANDQLLREQGLTVGQYLYQQHKEHPRRPLKGKVFSRKAYLEEFDRIWEAQAAHYPDILTPELREEIRDRIIYYQRPLKSQKHLIAECPFEKRYYKDANGQLQVKGIKVAPRSSPVFQEYKIWQTLANIRITNLALAGQMGFDDRGERPLTEQERELAYQYLIKKKKVKSDTLLKRALRLDPEAGGYSIDNYEEIEGDVTRAAILSAFKKAEQRPPQWLFRFDPTREIEQQPLFQLWHMLYSIEDPAALQRKLQEKFDFDDELAAALTRVTFKEDYGSLSTRAMQRLIPHLKNGLTYDKARVKVYEETGIDSYKTHTLSKDEQLQRALAPAIEQIKVNSLRNPVVERIVQHVINLVNAIIADKSLVSDEERQSGKFEIRMEMARELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANREKGNRTAYEYMEQKGELEKFREHVMNTNYPFPKKKRLLSPEVPEDFIQRQLKETQYITKVVREKLWEVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSRVVTSMTHRLKVKGHFSGKTQEVLVPRGPLHKESVYGLIHDNGKEEFVIRYPLDTNFRPEYVPYIVDKKVQQIVAARLRQFGNDPKKAFADLESDPIWFDEERKIPVKRVRCRTGLQAVVPVHHKADGTSVDYVQTRNNHHLAIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 677 - protein, 1134 aa, unidentified
  REGION 1..1134: note = Description of Unknown:uncultivated organism with predicted taxonomy:Deltaproteobacteria bacterium
  REGION 1..1134: note = MG7-14 effector
MKKILGLDIGTNSIGWALITEPENGESGEPEILRCGVKVIAMDQKQINAFEGGQALSANQERRLKRQMRRNNWRYKLRREALVARLVELGWFPREWKDDLQARHEALKLHDARYIYGLRDKAARGERITLRELGLIWYHLNQKRGYKSNRKAQDEEESNDSVLLSQIAANDQLLREQGLTVGQYLYQQYKEHPRRPLKGKVFSRKAYLEEFDRIWEAQAAHYPDILTPELREEIRDRIIYYQRPLKSQKHLIAECPFEKRYYKDANGQLQVKGIKVAPRSSPVFQEYKIWQTLANIRITNLALAGQMGFDDRGERPLTEQERELAYQFLIKKKKVKSDTLLKRALRLDPEAGGYSIDNYEEIEGDVTRAAILSAFKKAEQRPPQWLFRFDPTREIEQQPLFQLWHMLYSIEDPAALQRKLREKFDFDDELAAALTRVTFKEDYGSLSTRAMQRLIPHLKNGLTYDKARVKVYEETGIDSYKTHTLSKDEQLQRALAPAIEQIKVNSLRNPVVERIVQHVINLVNAIIADKSLVSDEERQSGKFEIRMEMARELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANKEKGNRTAYEYMEQKGELEKFREHVMNTNYPFPKKKRLLSPEVPEDFIQRQLKETQYITKVVREKLREVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSRVVTSMTHRLKVKGHFSGKTQEVLVPRGPLHKESVYGLIHDNGKEEFVIRYPLDTNFRPEYVPYIVDKKVQQIVAARLRQFGNDPKKAFADLESDPIWFDEERKIPVKRVRCRTGLHAVVPVHHKADGTPLDYVQTRNNHHLAIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 678 - protein, 1003 aa, unidentified
  REGION 1..1003: note = Description of Unknown:uncultivated organism with predicted taxonomy: Collinsella
  REGION 1..1003: note = MG14-1 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 679 - protein, 1034 aa, unidentified
  REGION 1..1034: note = Description of Unknown:uncultivated organism
  REGION 1..1034: note = MG14-3 effector
MAKLAPIADPRDFGFDPETVASALMPYEQFSSKPRRLILGIDMGVASIGLALIDVLNGEIVLMASHIFKQPIVDKTKVSLAVSRRGYRSSRRNITREKNRKKAIRKLAADTGIAPAGAAADWFARRKGEPEVLALRVDALTRKLTDRELARILYSFASHRGYIDHGKGDKGDTEDGKVKKALSANLKILDEGGYETYAQYLATQPRSRNKRDDYTFSIDIATVAHEVSRIFAHQREMGNTKATVSLEQSYLAALCWLTDTTKKDKKTYDKVGYCTYLGKPEKRAASSALSYELVRAYQTLANVKIEHRGAAPTCISPKTRNEIVADLFKVTGKPKPLKWSQLRKRLHMAETDTFAGRLKSDEAADCIKLPAWTALCAGLYDKAPKLLEDMHEEPDFADSVCSCLTFASGESSLRSALGNLSADFTPAELAALLDLPYTSKAFSGYGTSGLKALHMLRSAFESEDVVTLYDAEEATGLYEARAALAADRNASLDGLLSPYVEFDPTCTNPVVLRATARLRRMVNSVIKHYGMPDAIRVELARELKHSAHEKRLINASKNKNEKVNAKARQDLIDYYHLPSDAHIKTGDFRKVKLYNEQGGKDPYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQLNDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRNATGSLFNDSFYSYRGTDARGKDLLKQNGTVKPKTTVWKDGNGTAKTYDGVYGLHAVFDKDRGKSGRWLFDPIYYVDIPHLSKDRMRVFSKDKAIDYWETTEIDPESPQLMIKMGDVLLQDGRAMRFYNFNVATGGICSYVTGAPHKSLQKTGPLSCESFPTPMKWASDLKIMHEDSLGLCWLRFLVARTESCDGA

SEQ ID NO: 680 - protein, 1005 aa, unidentified
  REGION 1..1005: note = Description of Unknown:uncultivated organism with predicted taxonomy:Coriobacteriales
  REGION 1..1005: note = MG14-4 effector
MQSTVNREIGKLGLPRHLVMGMDPGISSCGFALIDTKNHEILEMGVRLFDSPTHPKTGQSLAVIRRGFRSTRRNIDRTQARLKHCLETLKRYGVVPQDATKDYFHTAKGDKQPLKLRVEGLDRLLTNREWALVLYSLCKRRGYIPHGEGSQDKSSEGGKVLSALAANKEAFDQGSFRTVGEWLASQPQSRNRGGSYDKCVTHAQLVNEAHTLFEKQRAFESKVASTELEAAYIEVCDWERSRKDFDCRTYELVGYCSYFPQEKRAARCTLTSELVSAYGALGNVTIIHEDGSSRSLTAAERDECIAILFSCEPIRGNKDCTVKFGALRKVLDLSSGDYFKGVPTSEEKTREVYKPKAWRVLRNTLNPINPILLHRLRDDRDLADSVMEAVAYSSALPVLEEKLQELPLSEAEVTALCKLPYSSKVLNGYGNRSKKALDILLGCFEEPEVLTLTDAEDASGLLAMRIEGAGLERSDRLMPYEGWIEKTGRTNNNPVVIRAMSQMRKVVNAICRKWGVPNEIHVELDRELRLPQCAKDDIAKANKKNEKNRERIAGQIAELRGCSVEEVTGKQIEKYRLWEEQECFDLYTGDSIDVMRLIQDDSYTQIDHILPFSRTGENSKNNKVLVLAKSNQDKREQTPYEWMHSGKPSAPSWSDFERRVQENQKLSRRKKNFLLEKDLDSKEGEFLARSFTDTAYMSREVCSYLSDCLLFPEDGSKVHVVPTTGRATAWLRRRWGLNFGSTGEKDRTDDRHHATDACVIAACSRSLVIKTAKISQETHWSVTPGLTESQRKDARMKALESVMPWETFANEVRSRHDFVVPTRFVPRKGKGELFEQTTYQYAGVNDKGKDLARRVGSDKDIVMGNAVVSEDGKSVVKVSEMLCLRLWHDPDAKKGKGCWYADPVYKADIPALKDGSYVPRIAKAHSGRKAWKPVPESALKGGTIEIYLGDIVRIGDFIGRFSGYDINSANWSFVDRLTRNPIKCPTVGKLNNLIIPIVTRENIVE

SEQ ID NO: 681 - protein, 1005 aa, unidentified; identical to SEQ ID NO: 680
  REGION 1..1005: note = Description of Unknown:uncultivated organism with predicted taxonomy: Actinobacteria
  REGION 1..1005: note = MG14-5 effector

SEQ ID NO: 682 - protein, 1037 aa, unidentified
  REGION 1..1037: note = Description of Unknown:uncultivated organism with predicted taxonomy: Collinsella
  REGION 1..1037: note = MG14-6 effector
MAKLAPIADPRDFGFDPETVASALMPYEQFSSKPRRLILGIDMGVASIGLALIDVENGEIVLMASHIFKQPIVDKTKVSLAVSRRGYRSSRRNITREKNRKKAIRKLAVKSGIAPAGASADWFARRKGEPEVLALRVDALTRKLTDRELARILYSFASHRGYIDHGKGDKDDIEGGKVKKALSANRKILDEGGYETYAQYLATQPRSRNKKDDYTFSIDIATVAHEVSRIFAHQREMGNTKVTVSLEQSYLAALCWLTDTTKKDKKTYDKVGYCTYLGKPEKRGASSALSYELVRAYQTLANVKIEHRGADATHISPKTRNEIVADLFKVTGKPKPLKWSQLRKRLHMAETDTFAGRLKSDEATDCITLPAWTALCVGLYDKAPKLLEDMHEEPDFADKVCSCLTFASSESSLRGALSQISADFSPVELAALLDLPYTSKVFSGYGTSSLKALHMLRGAFESEDVATLYKAEKATGLYEARAALAANRNASADGLLSPYVEFDPTCTNPVVLRATARLRRMVNSIIKHYGMPDAIRVELARELKHSAHEKRLINASKNKNEKINAKARQDLIDYYHLPSDAHIKTGDFRKVKLYNEQGGKDAYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQLNDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRNATGSLFNDSFYSYRGTDARGKDLLKQNGTVKPKTTVWKDGNGTAKTYDGVYGLHAVFDKDSGKSGRWLFDPIYYVDIPHLSKDRMRVFSKDKAIDYWETTEIDSESPQLIIKMGDVLLQDGRAMRFYNFNVATGGICSYVTGAPHKSLQKTGPLSCESFPTPMKWARDLKIMHEDSLGLCWLKFLTDRTDRCALESIQ

SEQ ID NO: 683 - protein, 1003 aa, unidentified
  REGION 1..1003: note = Description of Unknown:uncultivated organism with predicted taxonomy: Collinsella
  REGION 1..1003: note = MG14-7 effector
MEITINREIGKLGIPRHLVLGMDPGIASCGFALIDTANHEILDLGVRLFDSPNHPKTGQSLAVIRRGFRSTRRNIDRTQARLKHCLQTLKAYGVIPQDATKEYFHTTKGDKQPLKLRVQGLDRPLSNREWALVLYSLCKRRGYIPHGEGSQDKSSEGGKVLSALTANQEALAETPCRTVGEWLAQQPQSRNRGGNYDKCVTHAQLIDETHILFEAQRSFGSAYASPEFEAAYIEVCDWERSRKDFDRRTYDLVGHCPYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEVVAYSSALPVLQERLQGLPLSEAEIEALCRLPYSSKALNGYGNRSKKALDMLLDCLEEPEVLNLTQAENDCGLLGLRIAGTQLERSDRLMPYETWIERTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDGTYTQIDHILPFSRTGENSRNNKVLVLAKSNQDKREQTPYEWMSHDGAPSWDAFERRVQENQKLSRRKKNFLLEKDLGTKEGEFLARSFTDTAYMSREVCAYLADCLLFPDDGAKAHVVPTTGRTTAWLRRRWGLNFGLTGKKDRSDDRHHATDACVIAACSPSLVIKSAQINQKMHWSMTKGMSKAQRQDAIMKALENVMPWETFANEVRTVHKLIIPTRFVPRKGKGELFEQTVYRYAGVDAKGKTLARRANSTEDIVMGNAVVSDDEKSVIKVSEMLCLRLWHDPKAKKGQGAWYADPVYKADIPALKDGTYVPRIAKAHTGRKAWKPVPESAMKKPPLEIYLGDLVQIGDFVGRFNGYNIDNANWSFVDRLTRIKTSCPTVGKLSNDMSPFVVRESPIK

SEQ ID NO: 684 - protein, 1000 aa, unidentified
  REGION 1..1000: note = Description of Unknown:uncultivated organism with predicted taxonomy: Olsenella
  REGION 1..1000: note = MG14-8 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMSSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITEDKGKYPLVRAGENTVKKGNVRINPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 685 - protein, 1002 aa, unidentified
  REGION 1..1002: note = Description of Unknown:uncultivated organism with predicted taxonomy: Olsenella sp.KH3B4
  REGION 1..1002: note = MG14-9 effector
MDVTRPYLVLGLDPGIASCGFCLLDMTNHKILEMGSHLFKAPQEDKTKTSLAVTRRNARSIRRNTARTAARLKHCMELLVAAGLVPEDADKTWFQTRKGDKPVLKLRAGGLDRLLTDREFAQVLYSLCGRRGYIPHGEGRLGETDDTEGRKVLDAIKKNQAAMAAGSYRTVGEMLNAQGRSRNRGGDYALCVYNSQIQDEVKALFAAQRAHGNAAATEALEDDYLACLTWEKKSLEHDARVYELVGECPYFPGEKRAASADISSELCRAYERLGHIVIVHEDGSEQTLTANQIDGYLKILFSTASIKGNKDCKVTYGAIRKNLDISGKSVFKGIAQDKEKEEVFAPKAWRCLRHALPEELLARMVEDRQLGDAICEALTFASSEASLIERLSDLDLTDDEREAVLGVPFTGKLFKGYGSRSLKALGLLLGAFEEPEVRTLTDAERATGLLDLRQSDRGVRGQYLPPYNSYDETCRNPVVLRAMGRMRHIVNAIIRIHGVPDEIHIELGRELKMSNKEKSLVDKRNRENAAANKKWAEKAAGILGCTPEEVSGRVIRKLILREEQGEKDLYTGQPIDLERLVRDDRYCEIDHILPYSRTCDDSRTNKVLVLSKSNQDKRERTPYEWMTSGETGAPSWDEYHARIMATVKNPRKRANYLNTDLGPETQAKFLARNLNDDRYMSVAVKNYLEDCLLFPEDGRKRHVIAVAGGATGNLRWVWGLNFGDGNVKDRTDDRHHAVDAAIIAACSESTVKKIAEASSKGREAFKKQRESRLADTQPWPTFADEVKARRAFVVPTRMADHGVTGRVFEDTLYHLEGITADKGKYPLVRAGEKTVKKGNVRINSDGSVKLIDGMAFLRLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 686 - protein, 880 aa, unidentified
  REGION 1..880: note = Description of Unknown:uncultivated organism with predicted taxonomy: Collinsella
  REGION 1..880: note = MG14-10 effector
MLTSREWALVLYSLCKRRGYIPHGEGSQDKSSEGGKVLSALAANKEAIAETSCRTVGEWLAQQPQSRNRGGNYDKCVTHAQLVEETHILFEAQRNFGSQYASAELEEAYVQVCDWERSRKDFDRRSYDLVGYCTYFPTEKRAARCTLTSELVAAYGALGNITIVREDGTTRTLTAAERDKCIAILFSCEPIRGNKDCAVKFGALRRELDLNSGDYFKGVPAADEKTREVYKPKGWRTLRNTLNTISPFLLRRLHDDRDLTDSVMEAVAYSSALPVLEEQLQALPLSPTEIGALCKLPYSSKALNGYGNRSKKALDMLLDCLEDSEVLGLTQAEDDCGLLGLRTQGAQLKRSEHLMPYEMWVELTGRTNNNPVVIRSMSQMRKVVNAICRKWGVPNEIHIELDRELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRKGKGELFEQTTYRYAGVNDKGKDLARKANSDQDIVMGNAVVSEDGKSIIKVSEMLCLRLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 687 - protein, 813 aa, unidentified
  REGION 1..813: note = Description of Unknown:uncultivated organism with predicted taxonomy: Collinsella sp.AF20-14LB
  REGION 1..813: note = MG14-11 effector
MAAFENPRESGFDPELVKTALMSREQFCSKPRKLILGIDMGIADIGICLMDELNYEIVLMATHLFDCPRNPKDQTSLASTRRQARSQRRNIARRAARKKHIRTILMAHGVIPEGTTADWFSVRRGEQDNIQLRVKGLSEVLTDRELARVLYAFASRRGYIDHGKADNDKDAGKVKKALKANAEIMEANGYETFAQYLVTQPRIRNRQNDYTHCIDIDMVVDEVHAIFRHQRELGNELATESLEGEYLATLRWLTDTTRRDRIIYSKVGYCTYLGEPVKRAPKSSISSEMVRAYQTLANVKIEHIGGPATQIAPAVRNQIVHELFKVSKNPKPLKWSQLRKKLDLADTATFAGIRQSDEKNDACVTAPAWNALCSTLHDLNPTLLNRLHDDIDLADAVCAAATFASSSEAFATRIAELTDGLSKEDVEALLELQYGSKLFTGYGSTSLKALQMLRDAFEDAKIERLYDAEVATGLYDAREALAARHNAPDNGFLKPYSSYSPICTNPVVLRSCAQLRRIINSIIRHYGLPDTIRVEVANDLKHTKREKKLITSGNIYNRKVNEKAKDDIVEFLGLANADRVRGRDLEKVRLYNEQGGKDPYTGQGIDFGRMLTEKSYVEVDHVLPFSRSCDNSKTNKVLVLTKSNRDKANRTPYEWMTSGEPTAPNWDEFCIRMDVWASGKEPKHYYSSKLAKLKEDNFTNNIDSFISRNLNDTRYMSKDVAKWLADCLPFPKDGRRHVFCVSGAATGLMRRVWRIGILDENGKKDREDDRHHAVDAAVIAACTPSVVKSIALISEEHATHRDADRLLNRSLPY

SEQ ID NO: 688 - protein, 1005 aa, unidentified
  REGION 1..1005: note = Description of Unknown:uncultivated organism with predicted taxonomy: Collinsella
  REGION 1..1005: note = MG14-12 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKLSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 689 - protein, 1005 aa, unidentified
  REGION 1..1005: note = Description of Unknown:uncultivated organism with predicted taxonomy: Collinsella
  REGION 1..1005: note = MG14-13 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEDNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKAIDLSSGDYFKGVPAADEKTREVYKPKGWRVLRNTLNAANPILLQRLRDDRNLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 690 - protein, 1000 aa, unidentified
  REGION 1..1000: note = Description of Unknown:uncultivated organism with predicted taxonomy: Olsenella
  REGION 1..1000: note = MG14-14 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 691 - protein, 1005 aa, unidentified
  REGION 1..1005: note = Description of Unknown:uncultivated organism with predicted taxonomy:Coriobacteriales
  REGION 1..1005: note = MG14-15 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEDNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 692 - protein, 1046 aa, unidentified
  REGION 1..1046: note = Description of Unknown:uncultivated organism with predicted taxonomy: Eggerthellales
  REGION 1..1046: note = MG14-16 effector
MDKALGTDIGELGFDPGTFATALMTLEEFRSKDRVIWAGLDIGVASTGLCLVDVLNHEIVLMASHLFKSPVVDKKKATAAPESLASVRRGARSVRRNIMREGRRKKAIRAALSDFGLIPADAGGEWFAARRDERTVVRLRPKALEYLLNSREFARVLYSFASHRGYIDHGKSDKDDDAGKVKKALAANHAALADGGCKTFGQYLAGQPRSRNRPGNYSYTADIDMTVDEVRTIFARQRELGSEIASEALEERYIAELTWLTDTSKRDMSTYLKVSLCTYLGAPYRRGATSTISFEMVRAHQTLCNTVILHADGTSSTIPGNIRIEIVRELFAVKKSVKPLKWSGLRRRLGLAECDSFKGSPAEEEKRDCIALPAWAVLCSGLYEGHRDLLERLHDHIDDADAVCSALTYATSAASLAGRLAPLALTDDEVEAIIDLPYSARLFSGYASASLEALQMLRGTLEDPCVTSLRQAEEDSGLAQARAMLAEERGGAADGLLCAFSDYDPTCKNPVVLRATAQVRRMVNSAIRHYGLPDVIRVEVARELKRSKHEREVVAESNRARRELNEQAKRDIVEFLGLPDDHHVRGRDLDMVKLYREQGGKDPYTGAGIDFRRMLEEHGYAEIDHILPISRTCDDSQANKVLCLTKSNRDKSNRSPYEWMTSGEAAAPDWDEFCGRMDRWAKMCEPRRYVRKKLANLTCENLAEHAEDFIKRNLNDTRYMSAALAKWLRECLPFARDGHEHVFCVAGGATALMRSVWDIGITGPDGKKNRDDDRHHAVDAAVIACCTPGIVKNVALVNEGHARADVRQRLFSDSLPYPEFKEQVNAWIPCIVPTLTLPNTVTGSVLKDTVYPYLGRDEAGKDLYLTVKRDKDGRIVERKVNKATTMWKDGQGGCRAYGSMRALDAVFDASAGKRGRWSFDPVYCIDIPHRDAERRTIRAFSKEKAIDLWDTVEVPEAAPRMTIRRGDVLVCDGKAARFHCFDISVNAIRLFSQRGGKQLQATGPLSAEAFPPPSKWGEGVRVMQEDCLGLCWLSFLAQRAADMQSE

SEQ ID NO: 693 - protein, 1005 aa, unidentified
  REGION 1..1005: note = Description of Unknown:uncultivated organism with predicted taxonomy: Collinsella
  REGION 1..1005: note = MG14-17 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRDGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREAYKPKGWRVLRNTLNAANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 694 - protein, 1000 aa, unidentified
  REGION 1..1000: note = Description of Unknown:uncultivated organism with predicted taxonomy: Olsenella
  REGION 1..1000: note = MG14-18 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMLEDRKLGDAVCEALTFASSEASLIERLSDLGLSDDERDAILAVPFTGKLFKGYGSRSLKALDLLLGAFEEPEIRILTDAEKVTGLLDLRLSDRGVRGQLLPPYDSYDPTCRNPVVLRAMGRMRHIVNAIIRIHGVPDEIHIELGRDLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRACAIHIARVNWEPVPEAAMGANPVIVFFGDVLSVDDHVGRFGGFDIFGGRLALLNLLTKQKVSDWPSLGSWGKDTQVRVLQEDCLGHCYDSIAINPEGSTFQQR

SEQ ID NO: 695 - protein, 1005 aa, unidentified
  REGION 1..1005: note = Description of Unknown:uncultivated organism with predicted taxonomy:Coriobacteriales
  REGION 1..1005: note = MG14-19 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAAHCTLTSELVAAYGALGNITIVHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKNLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIAHKASSDKDIVMGNAVVSDDEKSIIKVSEMLCLRLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 696 - protein, 1005 aa, unidentified; identical to SEQ ID NO: 688
  REGION 1..1005: note = Description of Unknown:uncultivated organism with predicted taxonomy:Coriobacteriales
  REGION 1..1005: note = MG14-20 effector

SEQ ID NO: 697 - protein, 1000 aa, unidentified
  REGION 1..1000: note = Description of Unknown:uncultivated organism with predicted taxonomy: Olsenella sp.KH3B4
  REGION 1..1000: note = MG14-21 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 698 - protein, 1005 aa, unidentified; identical to SEQ ID NO: 693
  REGION 1..1005: note = Description of Unknown:uncultivated organism with predicted taxonomy: Collinsella
  REGION 1..1005: note = MG14-22 effector

SEQ ID NO: 699 - protein, 1005 aa, unidentified; identical to SEQ ID NO: 688
  REGION 1..1005: note = Description of Unknown:uncultivated organism with predicted taxonomy: Collinsella
  REGION 1..1005: note = MG14-23 effector

SEQ ID NO: 700 - protein, 1003 aa, unidentified
  REGION 1..1003: note = Description of Unknown:uncultivated organism with predicted taxonomy: Collinsella
  REGION 1..1003: note = MG14-24 effector
MTSTVNREIGKLGLPRHLVLGMDPGIASCGFALIDINNHEILEIGVRLFDSPTHPKTGQSLAVIRRGFRSTRRNIDRTQARLKHCLEVLEKYDVIPQDATKEFFHTTKGDKQPLKLRVEGLDRLLTNREWALVLYSLCKRRGYIPHGEGSQDKSSEGGKVLSALAANKEAFAETSCRTVGEWLAQQPQSRNRGGNYDKCVTHAQLIEETRVLFEAQRNFGSQYASAELEEAYVQVCDWERSRKDFDRRSYDLVGYCTYFPTEKRAARCTLTSELVAAYGALGNITIVHEDGTTRTLTAAERDKCIAILFSCEPIRGNKDCAVKFGALRRELDLNSGDYFKGVPAADEKTREVYKPKGWRALRNTLNTTSPFLLRRLYDDRDLADSVMEAVAYSSALPVLEEQLQALPLSPAEIDALCKLPYSSKALNGYGNRSKKALDMLLDCLEDSEVLGLTQAEDDCGLLGLRIQGSQLERSERLMPYEMWVELTGRTNNNPVVIRSMSQMRKVVNAICRKWGVPNEIHIELDRELRLPQRAKDDIAKAHKKNEKNRERIAGQIAELRGCNPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAKISEQTHWTVTKNLDKDERDHLRMKALENVMPWETFANEVRASHDFVIPTRFVPRKGKGELFEQTTYRYAGVNDKGKDLARKANSDQDIVMGNAVVSDDGKSVIKVSEMLCLRLWHDPEAKKGQGCWYADPVYKADIPALKAGTYVPKIAKAHTGRKAWKPVPESAMKHAPLEIYLGDLVKIGDFIGRFSGYNIDNANWSFTDRLTRQKLSCPTVGKLNNALIPVIIRESSIR

SEQ ID NO: 701 - protein, 1002 aa, unidentified
  REGION 1..1002: note = Description of Unknown:uncultivated organism with predicted taxonomy: Olsenella
  REGION 1..1002: note = MG14-25 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKIAEASSKGREAFKKQRESRLADTQPWPTFADEVKARRAFVVPTRMADHGVTGRVFEDTLYHLEGITADKGKYPLVRAGEKTVKKGNVRINSDGSVKLIDGMAFLRLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 702 - protein, 1005 aa, unidentified
  REGION 1..1005: note = Description of Unknown:uncultivated organism with predicted taxonomy: Coriobacteriia
  REGION 1..1005: note = MG14-26 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKLSEMLCLRLWHDPEAKKGQGAWYADPVYKADIPALKDGTYVPRIARAAIGRKAWKLVPKSAMTKPPLEIYLGDLVQIGNLFGRFSGYNIANGSWSFIDRLTKEALSCPSVAKLNNNLFPTIIRESIIMRK

SEQ ID NO: 703 - protein, 1005 aa, unidentified; identical to SEQ ID NO: 693
  REGION 1..1005: note = Description of Unknown:uncultivated organism with predicted taxonomy: Collinsella
  REGION 1..1005: note = MG14-27 effector

SEQ ID NO: 704 - protein, 1009 aa, unidentified
  REGION 1..1009: note = Description of Unknown:uncultivated organism with predicted taxonomy: Collinsella
  REGION 1..1009: note = MG14-28 effector
MAAFEDPRGHGFDPDLVRTALMSREQFSSKHRKLILGIDMGIADVGVCLMDELNHEIILMAAHLFDCPWNPKTKTSLASARRQARSQRRNIARRAARKKHIREILMAHDVIPEGATAEWFSVRKGDQDNIQLRVKGLSEVLDSRELARVLYGFAGRRGYIDHGKADNDKDAGKVKKALKTNAEIMEANGYETFAQYLITQPKIRNRQDDYTHCVDLDMVVDEVHAIFRHQRELGSNLATESLEGEYLAALRWLTDTTKRDRIIYSKVGYCTYLGEPIKRAPKSSISSEMVRAYQTLANVKIEHIGGPATQIAPAVRNQIVHELFKVSKKPKPLKWSQLRKKLDLDDTATFAGIRQSDEKKDICVKAPGWNTLCSTLHDLNPTLLNRLHDDIDLADAACAAATFASSSESFATRISELTDELSKEDVEALLELPYGSKLFTGYGSTSLKALQMLRDAFEDTSINRLHDAEVATGLYDARKALAAKHNVPDDGLLKPYSSYSPICTNPVVLRSCAQLRRIINSIIRHYGLPDTIRVEVAKELKHTKHEKKLVDDGNKYNKREKEKAADDIVEYLGLSSADQVRGRDIDKVRLYNEQGGKDLYTGQGIDFGRMLTEKGYVEIDHILPYSRSCDNSRTNKVLVLTKSNRDKANRTPYEWMTSGEPTAPNWDEFCIRMDVWASGKEPKHYYSSKLAKLKEDNFTNNIDSFISRNLNDTRYMSKDVAKWLTDCLPFPEDGRKHVFCVSGVATALMRGIWRIGILDDDGKKNREDDRHHAVDAAVIAACTPSIVRGIALISEEHATHRDADRLLNRSLPYPEYRDQVKAWIPCIVPTYSPNRTATGALFEENTYSYRGVNEKGKDLIKKKKGKLGPCTTAWKDGKGSAKAYDKQYSLLAVYDESTLRWLIDPLYYIDVQKRKHEEPFMRKFSKNLSIDYWEKIPLTGTERALFLKPGVVLTQDGLVGRLHSYDISDNKVRMYYARGETSFQKTGPLAGEKFPTFSKWTDNLKVMQE

SEQ ID NO: 705 - protein, 1005 aa, unidentified
  REGION 1..1005: note = Description of Unknown:uncultivated organism with predicted taxonomy:Coriobacteriales
  REGION 1..1005: note = MG14-29 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRDGNYDKCVTHAQLIEETHILFTAQRSFGSKYASPEFEAAYIEVCDWERSRKDFDRRTYDLVGHCSYFPTEKRAAHCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 706 - protein, 1005 aa, unidentified; identical to SEQ ID NO: 695
  REGION 1..1005: note = Description of Unknown:uncultivated organism with predicted taxonomy: Collinsella
  REGION 1..1005: note = MG14-30 effector

SEQ ID NO: 707 - protein, 1001 aa, unidentified
  REGION 1..1001: note = Description of Unknown:uncultivated organism with predicted taxonomy: Coriobacteriiabacterium
  REGION 1..1001: note = MG14-31 effector
MVSPKTTFSERESNYLVLGLDIGIGSCGWCILDKAHNIIVDMGVRLWSPPQENKTKASLASTRRAARSSRRNCKRTKDRKKHCFKLFKAEGIAPSDAEANWVQTKAGEKPTIKLRAAGLNRKLSSREWAQVLYSLCSRRGYIPHGESDDDSEGKAVLAAIKTQQEKLDNNEFRTVGELLANGTHCRNHSGDYSLCVSNNQIRNEVAALFEAQRKLGNKHASETFEQQYLECLTWQKSVTDHDEIIYSKVGPCTYFKQEKRAADSCLSSEMCKAFESICHVTYVDSDGVEGKLPPDIKQRAIDVWFSPTSLPKNKDCKVEYSDLRSWLKAELCIGDDFFFKGVERDDENSKEPFKPSRWRNQRKQLSPSLMLSMRNNRRLADGIDSALAYASSKESLQHQLDELPLSEVDIEELCSLSYSSRLYSGYGTRSLKALDLLIESFESDEVSTLAEAEKASGLLSLRQSSSTEKGFTLPPYIAFDPTCTNPVVLRVMGQVRKVINACIAEYGPFDEVHIELARELKQSAKEKDAILKSNNKTNKSREVLRKKLAEELSCDEDAIPFKLLEKIELWNQQDGRDLYVDEPIQYERLISDDSYCEIDHILPYSRTCDDSRMNKILVLQKSNQNKRESTPFEWMSATGDWDNFKLRILRLAHYPQKKKQRLLNTDLAEKQPEFIARNLNDTRYASLAAKRYIEEYLTFKDNGKSRHVIAVAGGATAALRNAWGIRKDRSEDNLHHAVDASIIAACDESTVIAIAKASERKALTPKDKRKELFSRTEPWQDFANEVLSRKEHIIPSFMTDHKVSGRIFEDTVYRFDGYNEAGTKGILTATKEGMPKSKPSGNYIVRDDGSAVIPDGLAFLRLWWDPTFKVRKGKEPGCYIPEPVFLSDLPKAFDCDYIPLIAPPQKDKKPREKWDSLSEELRNQKPVVLFRNDAIVIGSTVRRFAGFDIDGCSWTLLDPLGKMSQKEATKGLRISSIGPKTRFSVIHEDPLGKCFAPFLED

SEQ ID NO: 708 - protein, 839 aa, unidentified
  REGION 1..839: note = Description of Unknown:uncultivated organism with predicted taxonomy: Olsenella sp.KH3B4
  REGION 1..839: note = MG14-32 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLNLRLSDRGVRGQLLPPYDSYDPPCRNPVVLRAMGRMRHIVNAIIRIHGVPDEIHIELGRDLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASTKGREAFKQLRKSRLADTQPWPTFATEVAARREFVVPTRMADHGVTGRVFEDTLYHLEGITEDKGKYPLVRAGENTVKKGN

SEQ ID NO: 709 - protein, 1005 aa, unidentified; identical to SEQ ID NO: 693
  REGION 1..1005: note = Description of Unknown:uncultivated organism with predicted taxonomy: Collinsella
  REGION 1..1005: note = MG14-33 effector

SEQ ID NO: 710 - protein, 1000 aa, unidentified
  REGION 1..1000: note = Description of Unknown:uncultivated organism with predicted taxonomy: Olsenella
  REGION 1..1000: note = MG14-34 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLNLRLSDRGVRGQLLPPYDSYDPTCRNPVVLRAMGRMRHIVNAIIRIHGVPDEIHIELGRDLKMSNKEKKQVEKRNRENAASNKKWATTAAGILGCTPEEVPGRIIRKLILREEQGEKDLYTGDSIDLEHLVRDDRYCEIGHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 711 - protein, 1002 aa, unidentified
  REGION 1..1002: note = Description of Unknown:uncultivated organism with predicted taxonomy: Olsenella sp.KH3B4
  REGION 1..1002: note = MG14-35 effector
MERNRPYLVLGLDPGIGSCGFCLLDMTNHRILEMGSHLFDVPQEPKTKTSLAVTRRNARSIRRNTLRTRMRLKHCLGLLKDAGLVPQDADKNWLQSTKGDKPILKLRSCGLDRLLTDRELAQVLYSLCTRRGYIPHGEGRFGETDDVEGRKVLAAIKTNNKAMESGNYRTVGEMLHARGKSRNRGGNYDFCVLNSQIQDEVRTIFSAQRTLGNDRASTEFEEKYLDCLTWEKKTLDHDKRTYDLVGKCSYFPEERRAALACLSSELCRAYERLGHLVIVHEDNSEQVLTAQQIDVYLKVLFSPAPLKGNKDCKVTYSAIRRDLDLSGKSVFKGVSQEKEKDEVFAPKSWRRLRKTLPEDLMVRMRNNRELADDICEALTYASSEDSLLTQLEPLDLSENETEAVLGVPFSGKFFKGYGSRSRKALGILLGAFEEPEVRTLTDAEKATGLLDHRLANDTVRSVLLPPYVTYDETCRNPVVLRAMGRMRHVVNAIIRIHGVPDEIHIELGRDLKMSKREKDAVSKRQRQNEATNKKWAKTAAGILGCEPEEVPGKVIRKLAMREEQGEKDAYTNAPIDLERLVREDHYCEIDHILPYSRTSEDSRANKVLVLSKSNQDKRERTPYEWMTQDVGKPGVPNWDEYHARVVATVKHPRKRANLLNTDLGPETEAKFLARNLNDDRYMSVAVKNYLEDCLLFPDSDRKRHVTAIAGGATGNLRWVWGLNSGSNNTKDRSDDRHHAVDAAVIAACSEATVQKVARARSLGRETFKHMRKSRLADTQPWPTFADEVIARKEFVIPTRMADHGVTGRVFEDTLYHLEGFTDDKGKYPLVRAGQKTVKKGNVCISPDGSAKLIDGIAFVRLWLDPTARPNGKVKGKWYVEPVYYADIPAIRRGAYVPKACTIHVARTSWEPVPETALASRPITLYSGDVLRVDDHIGRYSSTDINGCRLVMLNLDSGNRVNDWPSIGSWGTTTQVQVLQEDCLGRCYGNVILHSDGSTFETR

SEQ ID NO: 712 - protein, 1003 aa, unidentified
  REGION 1..1003: note = Description of Unknown:uncultivated organism with predicted taxonomy:Coriobacteriales
  REGION 1..1003: note = MG14-36 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 713 - protein, 1038 aa, unidentified
  REGION 1..1038: note = Description of Unknown:uncultivated organism with predicted taxonomy: Coprococcuscomes
  REGION 1..1038: note = MG14-37 effector
MVEYSDPRDFGFRPETVMTALMPYEQYSSKTRRLILGIDMGIASVGVCLIDIRNHEIILMASHIFKAPVEGKQKDISARQSGASIRRDYRSVRRTTKRRKNRKKAVREIEKKYILIPDDADGQWFAIRKGEPDVLHLRGKALLYKLNGRELARILYAFAGRRGYIDHGKGATDNDSGKVKKALSENRKILDENGYETIAQYLLKQPTSRNREGDYRYMVDIEMVTDEVHTIFRHQRDLGSDIATEGLEGEYLSALRWLTDTSARDEKIYSRVGYCTYLGAPEKRAASSLISFEMVRAYEKLSNIKIEHQGREATYISPEKRNEIVESLFAVSKNPKPLKWSQLREKLGMQSSDSFDSRLPTDEKSDCIKIPAWNALCTGLFTSNRALLDRLHDDTDIADAVCSALTYASSGESLRNALENLSLDLSEQDIDSLLDLPYASKLFSGYCSTGVRALQMLRDAFKDPQIEKLYDAEMATGLYEARQALAAERNESKDGLLCPYLEFDPTCTNPVVLRATAQVRRMINSIIRHYGLPDIIRVEVAKDLKRSKHEKAIIAATNKANKDSNEQAKKDLVAFYGLPNDAHVSSADFEKMWLYREQFGQDPYTGKGINLERMLNERDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNLNDTRYMSRQLAMWVRECLPFPDDRRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRTATGSLLKDTVYPYVGVDDRGKDLYRRNGKIEPASTLWKDGEGGCKLYDGVYGLAGVFDRTLKKSGSWRFDPIYYIDVPNVRQDFIRDFSKALSIDYWPKVQLKGNEPRIFLKQGDVLLQDGCAMRYYMYDVSYGGVKSYSRIGKESISLQKTGPLAEEPFPKQMKWDSSLTVMQEDCLGLCWLRFLSDRADQFENSPV

SEQ ID NO: 714 - protein, 1003 aa, unidentified
  REGION 1..1003: note = Description of Unknown:uncultivated organism with predicted taxonomy: Coriobacteriiabacterium
  REGION 1..1003: note = MG14-38 effector
MEITINREIGKLGLPRHLVLGMDPGIASCGFALIDTANHEILDLGVRLFDSPTHPKTGQSLAVIRRSFRSTRRNIDRTQARLKHCLQVFKAYGLIPQDATKEYFHTTKGDRQPLKLRVDGLDRPLSAREWALVLYSLCKRRGYIPHGEGNQDKSSEGRKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCPYFPTEKRAARCTLTSELVSAYGALGNITIIHENGTSRALNATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 715 - protein, 1002 aa, unidentified
  REGION 1..1002: note = Description of Unknown:uncultivated organism with predicted taxonomy: Collinsella
  REGION 1..1002: note = MG14-39 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDALSKLPVKMPTIGRLNNETIPTVIRELLI

SEQ ID NO: 716 - protein, 1038 aa, unidentified
  REGION 1..1038: note = Description of Unknown:uncultivated organism
  REGION 1..1038: note = MG14-40 effector
MVEYSDPRDFGFRPETVMTALMPYEQYSSKTRRLILGIDMGIASVGVCLIDIRNHEIILMASHIFKAPVEGKQKDISARQSGASIRRGYRSVRRTTKRRKNRKKAVRDIEKKYVLIPDDADGQWFAIRKGEPDVLHLRGKALLYKLNGRELARILYAFAGRRGYIDHGKGTTDDDSGKVKKALSENRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVESLFAVSKNPKPLKWSQLREKLGMQSSDSFDSRLPTDEKGDCIKIPAWNALCRGLFTSNRALLDWLHDDTDIADAVCSALTYASSGESLRNALENLSLDLSEQDIDSLLDLPYASKLFSGYCNTGVRALQMLRDAFKDPQIEKLYDAEMATGLYEARQALAAERNESKDGLLCPYLEFDPTCTNPVVLRATAQVRRMINSIIRHYGMPDIIRVEVAKDLKRSKHEKAIIAATNKANKDSNEQVKKDLVAFYGLPNDAHVSSTDFEKMWLYREQFGQDPYTGKGINLERMLNDRDYVEIDHILPFSRSCDDSKSNKVLCLTKSNRDKANRTPYEWMTSGEPSAPDFGDFCGRMDAWAGKGKSAHYTKSKLSKLKNSTFGKEEQKFIDRNLNDTRYMSRQLAMWVRECLPFPDDKRQHVFCVAGAATSLMRRIWGIGVVDEKGKTDRSDDRHHAVDGAVIACCSPEIVKGIARVNSGRSNIKERERLRYESMPYPEFKDQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 717 - protein, 1003 aa, unidentified
  REGION 1..1003: note = Description of Unknown:uncultivated organism with predicted taxonomy: Collinsella
  REGION 1..1003: note = MG14-41 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 718 - protein, 1003 aa, unidentified
  REGION 1..1003: note = Description of Unknown:uncultivated organism with predicted taxonomy: Collinsella
  REGION 1..1003: note = MG14-42 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGTKIEVDRLISDDTYTQIDHILPFSRTGENSRNNKVLVLAKSNQDKREQTPYEWMSHDGAPSWNAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPKSAMKKPPLEIYLGDLVQIGDFVGRFSGYNIDNANWSFVDRLTRIKISCPTVGKLSNDMSPFVVRESPIK

SEQ ID NO: 719 - protein, 1003 aa, unidentified
  REGION 1..1003: note = Description of Unknown:uncultivated organism with predicted taxonomy: Collinsella
  REGION 1..1003: note = MG14-43 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMRYETWIERTGRTNNNPVVIRAMSQMRKVVNAICRKWGVPNEIHVELDRELRLPQRAKDEIAKANKKNEKNSERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 720 - protein, 761 aa, unidentified
  REGION 1..761: note = Description of Unknown:uncultivated organism with predicted taxonomy: Olsenellamediterranea
  REGION 1..761: note = MG14-44 effector
DFDRRTYDLVGHCSYFPTGKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 721 - protein, 833 aa, unidentified
  REGION 1..833: note = Description of Unknown:uncultivated organism with predicted taxonomy: Collinsella
  REGION 1..833: note = MG14-45 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFE

SEQ ID NO: 722 - protein, 1003 aa, unidentified; identical to SEQ ID NO: 712
  REGION 1..1003: note = Description of Unknown:uncultivated organism with predicted taxonomy: Collinsella
  REGION 1..1003: note = MG14-46 effector

SEQ ID NO: 723 - protein, 767 aa, unidentified
  REGION 1..767: note = Description of Unknown:uncultivated organism with predicted taxonomy: Collinsella sp.AM13-34
  REGION 1..767: note = MG14-47 effector
YRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLSPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFRVAGGATALMRSVWDIGITGPDGKKNRDDDRHHAVDAAVISCCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGWRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 724 - protein, 1003 aa, unidentified
  REGION 1..1003: note = Description of Unknown:uncultivated organism with predicted taxonomy: Collinsella
  REGION 1..1003: note = MG14-48 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSGMLCLRLWHDPEAKKGKGAWYADPVYKADIPALKDGTYVPRIAKAHTGRKAWKPVPGSAMKKPPLEIYPGDLVQIGDFVGRFSGYNIDNANWSFVDRLTRIKISCPTVGKLSNDMSPFVVRESPIK

SEQ ID NO: 725 - protein, 755 aa, unidentified
  REGION 1..755: note = Description of Unknown:uncultivated organism with predicted taxonomy: Collinsella sp.AF20-14LB
  REGION 1..755: note = MG14-49 effector
RAASSLISFEMVRAYEKLSNIKIEHQGREATYISPEKRNEIVESLFAVSKNPKPLKWSQLREKLGMQSSDSFDSRLPADEKSDCIKIPAWNTLCTGLFTSNRALLDRFHDDTDVADAVCSALTYASSGESLRNALENLSLDLSEQDIDSLLDLPYASKLFSGYCSTGVRALQMLRDAFKDPQIEKLYDAEKATGLYEARQALAAERNESRDGLLCPYLEFDPTCTNPVVLRATAQVRRMINSIIRHYGLPDVIRVEVAKDLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNLNDTRYMSRQLAMWVRECLPFPDDKRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRTATGSLLKDTVYPYVGADDRGKDLYRRNGKNEPASTLWKDGSGGCKLYDGVYGLMAVFDEGMKKFGSWRFDPIYYIDVPNVRQDFIREFTKDLSIDYWTKVQLKGDEPRIFLKQGDVLVQDGCAMRYYKYNVSNGAISSYSKIGEKSVPLQKTGPLSEEKFPKQAKWDSSLTVMQEDCLGLCWLRFLSDRVGKFENFPV

SEQ ID NO: 726 - protein, 1024 aa, unidentified
  REGION 1..1024: note = Description of Unknown:uncultivated organism with predicted taxonomy: Libanicoccusmassiliensis
  REGION 1..1024: note = MG14-50 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTILDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 727 - protein, 1005 aa, unidentified
  REGION 1..1005: note = Description of Unknown:uncultivated organism with predicted taxonomy: Collinsella
  REGION 1..1005: note = MG14-51 effector
MEITINREIGKLGLPRHLALGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQKCFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 728 - protein, 1003 aa, unidentified
  REGION 1..1003: note = Description of Unknown:uncultivated organism with predicted taxonomy: Collinsella
  REGION 1..1003: note = MG14-52 effector
MEITINREIGKLGLPRHLVLGMDPGIASCGFALIDTANHEILDLGVRLFDSPTHPKTGQSLAVIRRSFRSTRRNIDRTQARLKHCLQTLKAYGVIPQDATKEYFHTTKGDKQPLKLRVQGLDRPLSNREWALVLYSLCKRRGYIPHGEGSQDKSSEGGKILSALAANKEALAETPCRTVGEWLAQQPQSRNRGGNYDKCVTHAQLIDETHILFEAQRSFGSAYASPEFEAAYIEVCDWERSRKDFDRRSYDLVGRCSYFPAEKRAARCTLTSELVAAYGALGNITVIHEGGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHIELDRELRLPRRAKDEIAKANKKNEKNRERIARQIAELRGCTADEVTGKQIEKYRLWEEQECFDLYTGAKIEIGRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRLVPRKGKGELFEQTVYRYAGVDAKGKNLARRANSTEDIVMGNAVVSDDEKSIIKISEMLCLRLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKLRSPTVNKLSNDLPPLVIREPPIR

SEQ ID NO: 729 - protein, 1004 aa, unidentified
  REGION 1..1004: note = Description of Unknown:uncultivated organism with predicted taxonomy: Olsenella sp.KH3B4
  REGION 1..1004: note = MG14-53 effector
MDANRPYLVLGLDPGIASCGFCLLDMTNHKILEMGSHLFKAPQEDKTKVSLAVTRRNARSIRRNTARTAARLKHCLSLLVEADLVPPDADRAWFQTKKGDKPVLKLRATGLDRLLTDREFAQALYSLCGRRGYIPRGEGRLGEADDNDNEGKRVLDAIKKNQEAMEAGAYRTVGEMLNAQGRSRNRGGDYSLCVYNSQVQDEVKTLFKEQRALGNAKATKKLEQAYIDCLTWEKKSLDHDARVYELVGECVYFPEEKRAASADISSELCRAYERLGHLAIVREDGSDQALSAEQIAHYLGILFSTAPIKGNKDCKVTYGTIRKDLDISGKDVFKGVAQDKEKDEVFAPKAWRCLRRTLPQGLLERMFDDRKLGDAVCEALTFASSEASLVERLSGLELSDDEAEAILEVPFTGKLFKGYGSRSLKTLGLLLGAFEEPEIRILTDAEKATGLLDLRLSDRGVRGGLLPPYDEYDRTCRNPVVLRAMGRMRHIVNAIIRIHGVPDEIHIELGRDLKMSNKEKDLVDKRNRENEAAKKKWAKTAADILGIEPEEVPGRIVRKLIMREEQDNWDLYTGDAIDLERLVRDDRYCEIDHILPYSRTCDDSRANKVLVLSKSNQDKRERTPYEWMTSGEAGAPSWDEYRARVMALVKNPHKRANHLNTDLGEEAQAKFLARNLNDDRYMSVAVKNYLEDCLLFPEDGRKRHVTAVAGGATGNLRWVWGLNFGSGNVKDRDDDRHHAVDAAIIAACSEGTVQKVAKASSKGREAFKHLRESRLADTQPWPTFADEVIARREFVVPTRMVDHGVTGRVFEDTLYHLEGITEDKGKYPLVRAGEKVAKQGNVHVNPDGSVKLIDGMAFLRLWLDPTARPNGKVKGKWYAEPVYYADIPAIKAGTYVPRACTIHVARVNWKPVPEAAAQQKPVVLYPGDVLQVGSHVGRYRSFDISNCGLSVNSLVNKDVIAPGFPKTLGGWGKDTQVRVLQEDCLGNCYDHIAINPDDSTFRQR

SEQ ID NO: 730 - protein, 1000 aa, unidentified
  REGION 1..1000: note = Description of Unknown:uncultivated organism with predicted taxonomy: Olsenella sp.KH3B4
  REGION 1..1000: note = MG14-54 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTAGEIDDYLKILFSTAPIKGNKECKVTYGTIRKDLDISGKSVFKGIAQDKEKDKPFAPKAWRSLRRVLPERLLARMLEDRNLGDAVCEALTFASSEASLIERLSDLDLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNLNDDRYMSVAVKNFLEDRLLFPEDGRKRHVTAVAGGATGNLRWVWGLNFGEGNIKDRTDDRHHAVDAAIIAACSESTVKKVAKASAKAREAFKQLRKSRLADTQPWPTFAAEVAARREFVVPTRMADHGVMGRVFKDTLYHLEGITEDKGKYPLVRAGEKTVKKGNVRINPDGSVKLIDGMAFLRLWLDPTARPNGKVKGKWYAEPVYYADIPAIKAGAYVPRACTIHVARVNWKPVPEAAMQIEPIMLYAGDVVEINNQLVRYSGFDINGATLYYQSLLNGATTTAIPSLGTWGKDTQVRVLQEDCLGHCYDGIAINPEDSTFQQR

SEQ ID NO: 731 - protein, 1026 aa, unidentified
  REGION 1..1026: note = Description of Unknown:uncultivated organism with predicted taxonomy: Collinsella
  REGION 1..1026: note = MG14-55 effector
MAAFEDPRELGFDTELVKTALMTREQFSSKPRKLVLGIDMGIAGIGICLMDKLNQEIVLMATHLFDCPWNPKNKTSLASARRQARSQRRNTARRAARKKHIREILMARGVIPEGVTAEWFSVRKGEQDNIQLRVKGLSEILSSRELARILYGFASRRGYIDHGKADNDKDAGKVKKALKENAEIMDANGYETFAQYLVTQPRIRNRQNDYSHTIDIDMVVDEVHAIFRHQRELGNELATESLEGEYLAALRWLTDTTKRDRIIYSKVGYCTYLGEPIRRGPKSSISSEMVRAYQTLANVKIEHIGSVATHISPLTRNQIVHDLFKVSKNPKPLKWSQLRKKLDLADTDTFAGVRQSDEAKDVCVKVPAWNVLCSTLHDLNPALLNRLHDDVDLADAVCAAATFASSSESFATRIAERTDGLKQEDMEALLELPYGSKLFTGYGSTSLKALQMLRDAFEDTNINRLYDAEVATGLYDAREALAAKRNASDDGLLMPYSKYSPICTNPVVLRSCAQMRRIINSIIRHYGLPDTIRVEVANDLKRTEHERKLITSGNIYNRRTNEKAKDDIVEYLGLSDADQVRGRDIDKVRLYNEQGGKDPYTGQGIDFGRMLTEKGYVEIDHILPFSRSCDNARTNKVLVLTKSNRNKSNRTPYEWMTSGEPTAPNWDEFCIRMDVWASGKEPKHYYSSKLAKLKEDNFTNNIDSFISRNLNDTRYMSKDVAKWLADCLPFPEDGRKHVFCVSGAATAFMRGIWRIGILDDVGKKNREDDRHYAVDAAVIAACTSSIVKGIALISEEHATNRDADRLLDGSLPYPEYRDQVKAWIPCIVPTYSPTRTATGALFKENTFSYKGIDGKGKDLIKKKKGALGPCTTAWKDGKGTARAYDEQYSLLAVYEESAARWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 732 - protein, 1003 aa, unidentified
  REGION 1..1003: note = Description of Unknown:uncultivated organism with predicted taxonomy: Collinsella
  REGION 1..1003: note = MG14-56 effector
MEITINREIGKLGLPRHLVLGMDPGIASCGFALIDTANHEILDLGVRLFDSPNHPKTGQSLAVIRRGFRSTRRNIDRTQARLKHCLQTLKAYGVIPQDATKEYFHTTKGDKQPLKLRVQGLDRPLSNREWALVLYSLCKRRGYIPHGEGSQDKSSEGGKILSALAANKEALAETPCRTVGEWLAQQPQSRNRGGNYDKCVTHAQLIDETHILFEAQRSFGSAYASPEFEAAYIEVCDWERSRKDFDRRSYDLVGRCSYFPAEKRAARCTLTSELVAAYGALGNITVIHEGGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPRRAKDEIAKANKKNEKNRERIARQIAELRGCTADEVTGKQIEKYRLWEEQECFDLYTGAKIEVGRLISDDTYTQIDHILPFSRTGENSRNNKVLVLAKSNQDKREQTPYEWMSHDGAPSWDAFERRVQENQKLGRRKKNFLLEKDLDTKEGEFLARSFTDTAYMSREVCAYLADCLLFPNDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRFVPRKGKGELFEQTVYRYAGVDAKGKNLARRANSTEDIVMGNAVVSDDEKSIIKISEMLCLRLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKFRSPTVNKLSNDLSPLVIREPPIR

SEQ ID NO: 733 - protein, 1000 aa, unidentified
  REGION 1..1000: note = Description of Unknown:uncultivated organism with predicted taxonomy: Olsenella
  REGION 1..1000: note = MG14-57 effector
MDVTRPYLVLGLDPGIASCGFCLLDMTNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHTVIVHEDGSEQALTAGEIDGYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLDLSDDERDAILAVPFTGKLFKGYGSRSLKALGLLLGAFEEPEIRILTDAEKVTGLLDLRLSDRDVRGQLLPPYSSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNLNDDRYMSVAVKNFLEDRLLFPEDGRKRHVTAVAGGATGSLRWVWGLNFGEGNIKDRTDDRHHAVDAAIIAACSESTVKKVAEASAKGREAFKQLRKSRLADTQPWPSFAAEAAARREFVVPTRMADHGVTGRVFEDTLYHLEGITEDKGKYPLVRAGEKTVKKGNVRINPDGSVKLIDGMAFLRLWLDPTARPNGKVKGKWYAEPVYYADIPAIKAGTYVPRACTIHVARVNWEPVPEAAMEIEPVVLYAGDVVEINNQLVRYSGFNIRGATLYYQSLLNGATTTAIPSLGSWGKDTQVRVLQEDCLGHCYDGIAINPEDSTFQQR

SEQ ID NO: 734 - protein, 1003 aa, unidentified
  REGION 1..1003: note = Description of Unknown:uncultivated organism with predicted taxonomy: Collinsella
  REGION 1..1003: note = MG14-58 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 735 - protein, 1003 aa, unidentified
  REGION 1..1003: note = Description of Unknown:uncultivated organism with predicted taxonomy: Collinsella
  REGION 1..1003: note = MG14-59 effector
MEITINREIGKLGLPRHLVLGMDPGIASCGFALIDTANHEILDLGVRLFDSPTHPKTGQSLAVIRRSFRSTRRNIDRTQARLKHCLQVFKAYGLIPQDATKEYFHTTKGDRQPLKLRVDGLDRPLSAREWALVLYSLCKRRGYIPHGEGNQDKSSEGRKVLSALAANKEAIAETSCRTVGEWLAQQPQSRNRGGNYAKCVTHAQLIEETHILFDAQRSFGSKYASPEFEAAYIEVCDWERSRKDFDRRTYDLVGHCPYFPTEKRAARCTLTSELVSAYGALGNITIIHENGTSRALNATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 736 - protein, 1003 aa, unidentified; identical to SEQ ID NO: 732
  REGION 1..1003: note = Description of Unknown:uncultivated organism with predicted taxonomy: Collinsella
  REGION 1..1003: note = MG14-60 effector

SEQ ID NO: 737 - protein, 1004 aa, unidentified
  REGION 1..1004: note = Description of Unknown:uncultivated organism with predicted taxonomy: Collinsella
  REGION 1..1004: note = MG14-61 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLGRLLNDREWALVLYSLCKRRGYIPHGEGNQDKSSEGGKVLSALAANKETIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRALRNTLNAANPILLQRLRDDHDLADAVMEAVAYSSALPVLQEQLQGLPLSEAEIEALCRLPYSSKALNGYGNRSKKALDMLLDCLEEPEVLNLTQAENDCGLLGLRIAGSQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQNYGRKVWKAIPDSLLIQKPLEIYLGDLIRVGDKLGRYNGYNIAKANWSFVDALTKKEIAFPSVGMLSNELRPIVIRKSILDN

SEQ ID NO: 738 - protein, 1003 aa, unidentified
  REGION 1..1003: note = Description of Unknown:uncultivated organism with predicted taxonomy: Collinsella
  REGION 1..1003: note = MG14-62 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKFASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALENVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 739 - protein, 1046 aa, unidentified
  REGION 1..1046: note = Description of Unknown:uncultivated organism with predicted taxonomy: Collinsella
  REGION 1..1046: note = MG14-63 effector
MDKAPGTDIGELGFDPGAFATALMTPEEFRSKDRVIWAGIDIGVASTGLCLVDILNHEIVLMASHLFKSPVVDKKKATAAPESLASVRRSARSVRRNIMREGRRKKAIRAVLADFGLIPADAGGEWFSARRDERTVVRLRSKALGYLLNPRELARVLYSFASHRGYIDHGKSDKEDDAGKVKKALAANRAELADGGCETFGQYLAAQPRSRNRAGDYSYTADIGMTVDEVRTIFARQRELGSEIASEALENRYIAELTWLTDTSKRDMSTYLKVGFCTYRGAPYRRGATSTISFEMVRAHQTLCNTVIQHADGTSSSIPGDTRIEIVRELFAVKKSVKPLKWSGLRRRLGLSEGDSFKGRPLEEEKRDCIALPAWAVLCSGLYEGHRDLLERLHDHIDDADAVCSALTFASSAASLAGRLAPLALSDDEVEAIIDLPYSARLFSGYANASLEALQMLRGTFEDPRVTSLRQAEEDSGLAQARAILAEERGEADDGLLCAFSDYDPTCKNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGVGIDFRRMLEEHGYAEIDHILPVSRTCDDSQANKVLCLTKSNRDKSNRSPYEWMTSGEASAPDWNGFCGRMERWAKMCEPRRYARKKLANLTCENLAERAGNFIDRNLNDTRYMSVALAKWLMECLPFAKDGHEHVFCVAGGATALMRSVWNIGITGPDGKKNRDDDRHHAVDAAVIACCTPGIVKNVALVNEGHARADVRQRLFRDSLPYPEFKEQVDAWIPCIVPTLTLPSTVTGSVLKDTVYPYLGRDEAGKDLYLTVNRDKDGRIVERKVNKATTMWKDGHGGCRKYDEMCALDAVFDASVGKRGKWAFDPVYCIDIPHRDAERRTMRAFSKEKAIDLWDTVEVPEDALRMTIRRGDVLVCDGKAARFHGFNISDNTIKLFPQRVGKQLQETGPLSDEAFPSPSKWGDGIRVMQEDCLGLCWLSFLAQRAAVTQTE

SEQ ID NO: 740 - protein, 1003 aa, unidentified
  REGION 1..1003: note = Description of Unknown:uncultivated organism with predicted taxonomy: Collinsella
  REGION 1..1003: note = MG14-64 effector
MASTVNREIGKLGLPRHLVLGMDPGIASCGFALIDINNHEILEIGVRLFDSPTHPKTGQSLAVIRRGFRSTRRNIDRTQARLKHCLEVLEKYDVIPQDATKEFFHTTKGDKQPLKLRVEGLDRLLTNREWALVLYSLCKRRGYIPHGEGSQDKSSEGGKVLSALAANKEAFAETSCRTVGEWLAQQPQSRNRGGNYDKCVTHAQLIEETRVLFEAQRSFGSQYASAELEEAYVQVCDWERSRKDFDRRSYDLVGYCTYFPTEKRAARCTLTSELVAAYGALGNITIVHEDGTTRTLTTAERDKCIAILFSCEPIRGNKDCAVKFGALRRELDLNSGDYFKGVPAADEKTREVYKPKGWRALRNTLNTTSPFLLRRLYDDRDLADSVMEAVAYSSALPVLEEQLQALPLSPAEIDALCKLPYSSKALNGYGNRSKKALDMLLDCLEDSEVLGLTQAEDDCGLLGLRIQGSQLERSERLMPYEMWVELTGRTNNNPVVIRSMSQMRKVVNAICRKWGVPNEIHIELDRELRLPQRAKDDIAKAHKRNEKNRERIAGQIAELRGCSPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEENLEAKEGEFLARSFTDTAYMSREVCAYLADCLLFPEDGTKSHVVPTTGRATAWLRRRWGLNFGINGEKDRSDDRHHATDACVIAACSRSLVIKTAKISEQTHWAVTKDLDKDERDHLRMKALENVMPWETFANEVRASHDFVIPTRFVPHKGKGELFEQTTYRYAGVNSEGKDLARRANSDQDIVMGNAIVSDDGKSIIKVSEMLCLRLWHDPEAKKGQGCWYADPVYKADIPALKDGTYMPKIAKARTGRKAWKPVPECAMRHAPLEIYLGDLVKIGDFIGRFSGYNIANANWSFTDRLTRQKLSCPTVGKLNNALIPVIIRESSIR

SEQ ID NO: 741 - protein, 1003 aa, unidentified; identical to SEQ ID NO: 732
  REGION 1..1003: note = Description of Unknown:uncultivated organism with predicted taxonomy: Collinsella
  REGION 1..1003: note = MG14-65 effector

SEQ ID NO: 742 - protein, 1004 aa, unidentified
  REGION 1..1004: note = Description of Unknown:uncultivated organism with predicted taxonomy: Collinsella
  REGION 1..1004: note = MG14-66 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYLHTTKGDKQPLKLRVDGLDRLLNDREWALVLYSLCKRRGYIPHGEGNQDKSSEGGKVLSALAANKEAIAETSCRTVGEWLAWQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPFSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREACAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSLDEKSVIKVSEMLCLRLWHDPEAKKGQGAWYADPVYKADIPALKDGTYVPRIAKAHTGRKAWKPVPESAMKKPPLEIYLGDLVQIGDFMGRFSGYNIANANWSFVDRLTKEALGCPTVVKLDNKLAPAIIRESIIMH

SEQ ID NO: 743 - protein, 1003 aa, unidentified; identical to SEQ ID NO: 734
  REGION 1..1003: note = Description of Unknown:uncultivated organism with predicted taxonomy: Collinsella
  REGION 1..1003: note = MG14-67 effector

SEQ ID NO: 744 - protein, 1005 aa, unidentified
  REGION 1..1005: note = Description of Unknown:uncultivated organism with predicted taxonomy: Collinsella
  REGION 1..1005: note = MG14-68 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFETAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 745 - protein, 1000 aa, unidentified
  REGION 1..1000: note = Description of Unknown:uncultivated organism with predicted taxonomy: Olsenella
  REGION 1..1000: note = MG14-69 effector
MAEPYLVLGLDPGISSCGFALLDMNNHKILEMGSHLFDAPQDSQTKVSLAVGRRSARSARRNNLRTKNRQKHCMELLQEAGLVPQGVTKQWFQSTKGDRPLLELRFAALERPLTNREFAQVLYALSARRGYIPHGEGRISKLSDMDTSGSSDAEAGKVLKAIGENNKLMAQGHFRTVGEMLYDQGKSRNKGGSYERCVLNSQIVDEVHIIFQSQRTQQNTAATQELEAQYVQNLTWEKRTLDHDAKVHALVGKCSYFPGEFRAARADLSSELCNAYERIKHLRIVNADGDEVALAPEQVETYIAILFSPEPLKGKKEKVTYARIRKDLDLSAHLFFKGIDPEDEKDHEPYVPKAWRAMRKVLSTELMERLRSDRTLADAVGEALTYASSEDSLVYQLDNLDLSDEERSQILGLPFSGKIFKGYGSRSLKALDMLVDAFEEPEVTTLAEAEESSGLLGLRMSDRGARYPLLPSYSNYDKENRNPVVLRAMGRMRRIVNAIIRIYGVPDEIHVELGRDLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGAPNWDEYQARVIANHHISPRKRRYLLDNNLGPDQESDFLSRNLNDDRYMSREVKSYLEDTLIFPEDGRVKHVIAVAGGATGSLRHVWGLNFGANNSKDRSDNRHHAIDACVIAACSESTLQAVAKARKLGAETYKRMRKDRLKDTQPWPTFADEVIARREFVIPTHMVSHGVTGRAFEDTNYRFDGITNDTKKLGILYGNGKTTKKGNFVIGNDGNAHLVDGMAFLRLWLDPTARKGKGKWYAEPVYYADIPAIKNGTYIPRAAKAHVARVAWEPVPENALASAPVVLFSDNVIKVGSAIARYSRFDIGNAALVLENLRTGEECKKFPTLGRWNNELVPIIINEDCLGHCYKELAPNILEG

SEQ ID NO: 746 - protein, 1026 aa, unidentified
  REGION 1..1026: note = Description of Unknown:uncultivated organism with predicted taxonomy: Collinsellatanakaei
  REGION 1..1026: note = MG14-70 effector
MESLVNREVGGLGKPRYLVMGMDPGIKSCGFALLDLNNQEILEMGSRLFDAPTHPKTKQSMAVIRRGYRSTRRNIDRTQDRLKHCLKTLKRFDVVPEDADKEFFHTVKGDKQPILLRTDGLNRLLTSREWALVLYSLCKRRGYIPHGEGSDSGTSEDGKVLAALKANERVFADAGYRTVGEWLASLPQSRNRGGNYDKCVTHAQLTDEVRTLFEAQRGFGSPVASQELEDAYIEVFDWERSREEFDKRAYGLVGTCSYFPNEKRAARCTLTSEMVAAYGALGNITIVKRDGSTHPLSAVERDQCIDILFAVDPMKGNKTCAVKYGFLRKRLDLESGDYFKGVPLDDEKNREVFKPKGWRSLRSVLHETNRELLVKLHDDRDLADAVMEAVAYSSSVDVLKSQLSSLDLSNGEIESICAMPYSSKVLNGYGNRSKKALDILLGCFEDPDVLSLTDAEDASGLGAVRMQGAAIDKGERLIPYETWIALTGRTNNNPVVIRALSQMRKVVNAVCRKWGVPDEIHVELDRELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNMTDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRKGRGELYGQTVYSYLGVDESGKDLGRKKGSNKKIVMGNAVISKDGKSMVKISEMLCLRLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 747 - protein, 862 aa, unidentified
  REGION 1..862: note = Description of Unknown:uncultivated organism with predicted taxonomy: Collinsella
  REGION 1..862: note = MG14-71 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGAFGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPAVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVISACSRSLVIKTARINQETHWSITRGMNETQRRDAIMKALESVMPWETFANEVRAAHDFVVPTRFVPRKGKGELFEQTVYRYAGVNAQGKDIARKASSDKSDGAG

SEQ ID NO: 748 - protein, 895 aa, unidentified
  REGION 1..895: note = Description of Unknown:uncultivated organism with predicted taxonomy: Atopobium sp.ICM42b
  REGION 1..895: note = MG14-72 effector
YINRGEETLINGEVSTEVSSESEEAGKVLSAISENKKALKESGYRSFGEYLYKESYVSTRSYRNKAGDYKHCVSHPMVVDEIKELFEQQKKFGNTHTSEEFKYAYLEQLNWLKDTKAFDKLTYQKVGYCVYFDQYSDEPQKRSANADLISEVVKAYEKLGNIRLKFDDKPEQSLTREVRDAVINEMFSVHQGAKVKSVTYKTLRKLIDDDNLIGFKGVKSDLEKNPVFVPKAWNTFCRVLSGSESGIQLLNRMRSDFKFANAIAESLTYASSLDSLERRISMYQEKEDLVISEDELALIESLPYNTKIFKGYGSRSVQALEMLHDQFSDGEAFTLDEAEKQSGLQGFRLREKGIRQSLLPPYSDYDVQCTNPVVLRVLAQARRMINSAIKQYGMPNIIRIELGNDIAKSAKEKSKIAKGQNENRKENERIKDKIAEILHIDQSEVTGKQITKMKLYEEQGGKDIYTGEGLGDIAFAGGRRFLIDDNYCEIDHVLPYSRSADDLKSNKVLVLAKSNQEKGNRTPYEWMNSNDGSHPNWEQFCLRVLSNVRLSDGKKSKLLEENFAEKEVSFIKRNMVDTQYMARAISAWLSDSLNFSTEFNQKQHVYAVNGRMTAKLRRKWGLNFGEDDTKDRSDNRHHAIDAAVIAVCSASMVKEFAISYSRLREVRDSVIAEPWEGFADQVREAREWVIPTMYRPNKKNGLLFEESRYRYVEKKKKHILTSKDGKEKSSGNIRFFENEKDGRHVKIVGNIAYIRLWLDENARKGKGEWLIEPVYFVDLQSIKNGSYVPRYISASHVTSDEWKSIPEEVLSKIPPVVIHIQDVIQVDSSYFRVDGVDIDAKALNLMPVFSDSNNSDPALAKMSKWNKSTEVTRISEDALGLVWFNYLKNQNSSES

SEQ ID NO: 749 - protein, 1003 aa, unidentified
  REGION 1..1003: note = Description of Unknown:uncultivated organism with predicted taxonomy: Collinsella
  REGION 1..1003: note = MG14-73 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNTANPILLQRLRDDRNLADAVMEAVAYSSALPVLQEQLQGLPLSEAEIEALCRLPYSSKALNGYGNRSKKALDLLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDSKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 750 - protein, 1026 aa, unidentified
  REGION 1..1026: note = Description of Unknown:uncultivated organism with predicted taxonomy: Collinsella
  REGION 1..1026: note = MG14-74 effector
MAAYEDPRDCGFDPELVKTALMSREQFGSKPRKLVLGIDMGIAGIGICLMDKLNQEIVLMATHLFDCPWNPKNKTSLASARRQARSQRRNIARRTARKKHIREILMARGVIPEGVTAEWFSVRKGEQDNIQLRVKGLSQILSSRELARVLYGFASRRGYIDHGKADNDKDAGKVKKALKENAEIMDANGYETFAQYLVTQPRIRNRQNDYSHTIDIDMVVDEVHAIFRHQRELGNELATESLEGEYLAALRWLTDTTKRDRIIYSKVGYCTYLGEPIRRGPKSSISSEMVRAYQTLANVKIEHIGSVATHISLLTRNQIVHDLFKVSKNPKPLKWSQLRKKLDLADTDTFAGVRQSDEAKDVCVKVPAWNVLCSTLHDLNPTLLNRLHDDVDLADAVCAAATFASSSESFATRIAERTDGLKQEDMEALLELPYGSKLFTGYGSTSLKALQMLRDAFEDTNINRLYDAEVATGLYDAREALAAKRNASDDGLLMPYSKYSPICTNPVVLRSCAQMRRIINSIIRHYGLPDTIRVEVANDLKRTEHEKKLITSGNIYNRRTNEKAKDDIVEYLGLSEADQVRGRDIDKVRLYNEQGGKDPYTGQGIDFGRMLTEKGYVEIDHILPFSRSCDNARTNKVLVLTKSNRDKSNRTPYEWMTSGEPTAPNWDEFCIRMDVWASGKEPKHYYSSKLAKLKEDNFTNNIDSFISRNLNDTRYMSKDVAKWLADCLPFPEDGRKHIFCVSGAATAFMRGIWRIGILDDAGKKNREDDRHYAVDAAVIAACTSSIVKDIALISEEHATNRDADRLLDGSLPYPEYRDQVKAWIPCIVPTYSPTRTATGALFKENTFSYKGIDGKGKDLIKKKKGALGPCTTAWKDGKGTARAYDEQYSLLAVYEESASRWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 751 - protein, 1046 aa, unidentified
  REGION 1..1046: note = Description of Unknown:uncultivated organism with predicted taxonomy: Collinsella sp.AM13-34
  REGION 1..1046: note = MG14-75 effector
MDKAKGADIGELGFDPATFATALMTLEEFRSKDRVIWAGLDIGVASTGLCLVDVRNHEIVLMASHLFKSPVVDKKKATAAPESLASVRRGARSIRRNIMREGRRKKAIRAALADFDLIPADADGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRDLFAVKKSVKPLKWSGLRRRLGLSEGDSFKGRPVEEEKRDCIALPAWAVLCAGLYENHRDLLERLHDHIDDADAVCSALTFASSAASLTGRLAPLALSDDEVEAIIDLPYSARLFSGYANASLEALQMLRGTFEDPRVTSLRQAEEDSGLAQARAILAEERGGSADGLLCAFSDYDPTCRNHVVLRATAQVRRMVNSVIRHYGLPDVIRVEVARDLKRSKHEREIVAESNRARLELNEQAKRDIIEFLGLPDDHHVRGRDLALVKLYREQGGKDPYTGAGIDFRRMLEEHGYAEIDHILPVSRTCDDSQANKVLCLTKSNRDKSNRSPYEWMTSGEASAPDWGEFCGRMERWAKMCEPRRYARKKLANLTCENLTERAGNFIDRNLNDTRYMSVALAKWLRECLPFAKDGHEHVFCVAGGATALMRSVWNIGITGPDGKKNREDDRHHAVDAAVIACCTPGIVRNVALVNEGHARADVRQRLFSDSLPYPEFKEQVDAWIPCIVPTLTLPNAVTGSVLKDTVYPYLGRDEAGKDLYLTVKRDKDGRIVERKVNKATTMWKDGQGGCRAYGSMCALEAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQTTGPLSAEAFPPPSKWGEGVRIMQEDCLGLCWLSFLAQRAADVQME

SEQ ID NO: 752 - protein, 1003 aa, unidentified
  REGION 1..1003: note = Description of Unknown:uncultivated organism with predicted taxonomy: Collinsella
  REGION 1..1003: note = MG14-76 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 753 - protein, 1003 aa, unidentified
  REGION 1..1003: note = Description of Unknown:uncultivated organism with predicted taxonomy: Collinsella
  REGION 1..1003: note = MG14-77 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKTNKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 754 - protein, 1004 aa, unidentified
  REGION 1..1004: note = Description of Unknown:uncultivated organism with predicted taxonomy: Collinsella
  REGION 1..1004: note = MG14-78 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWELNFGSNREKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 755 - protein, 1003 aa, unidentified
  REGION 1..1003: note = Description of Unknown:uncultivated organism with predicted taxonomy: Collinsella
  REGION 1..1003: note = MG14-79 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 756 - protein, 1003 aa, unidentified
  REGION 1..1003: note = Description of Unknown:uncultivated organism with predicted taxonomy:Coriobacteriales
  REGION 1..1003: note = MG14-80 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFARRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 757 - protein, 1004 aa, unidentified
  REGION 1..1004: note = Description of Unknown:uncultivated organism with predicted taxonomy: Collinsella
  REGION 1..1004: note = MG14-82 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSDLPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 758 - protein, 1003 aa, unidentified
  REGION 1..1003: note = Description of Unknown:uncultivated organism with predicted taxonomy: Collinsella
  REGION 1..1003: note = MG14-83 effector
MTSTVNREIGKLGLPRHLVLGMDPGIASCGFALIDINNHEILEIGVRLFDSPTHPKTGQSLAVIRRGFRSTRRNIDRTQARLKHCLEVLKKHGVIPQDATKEFFHTTKGDKQPLKLRVEGLDRMLTSREWALVLYSLCKRRGYIPHGEGSQDKSSEGGKVLSALAANKEAIAETSCRTVGEWLAQQPQSRNRGGNYDKCVTHAQLVEETHILFEAQRNFGSQYASAELEEAYVQVCDWERSRKDFDRRSYDLVGYCTYFPTEKRAARCTLTSELVAAYGALGNITIVREDGTTRTLTAAERDKCIAILFSCEPIRGNKDCAVKFGALRRELDLNSGDYFKGVPAADEKTREVYKPKGWRTLRNTLNTISPFLLRRLHDDRDLTDSVMEAVAYSSALPVLEEQLQALPLSPTEIGALCKLPYSSKALNGYGNRSKKALDMLLDCLEDSEVLGLTQAEDDCGLLGLRTQGAQLKRSEHLMPYEMWVELTGRTNNNPVVIRSMSQMRKVVNAICRKWGVPNEIHIELDRELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRKGKGELFEQTTYRYAGVNDKGKDLARKANSDQDIVMGNAVVSEDGKSIIKVSEMLCLRLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 759 - protein, 1000 aa, unidentified
  REGION 1..1000: note = Description of Unknown:uncultivated organism with predicted taxonomy: Olsenella
  REGION 1..1000: note = MG14-84 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRASGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 760 - protein, 1003 aa, unidentified
  REGION 1..1003: note = Description of Unknown:uncultivated organism with predicted taxonomy: Collinsella
  REGION 1..1003: note = MG14-85 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIHNANWSFVDRLTRIKISCPTVGKLSNDMSPFVVRESPIK

SEQ ID NO: 761 - protein, 1003 aa, unidentified; identical to SEQ ID NO: 717
  REGION 1..1003: note = Description of Unknown:uncultivated organism with predicted taxonomy: Collinsella
  REGION 1..1003: note = MG14-87 effector

SEQ ID NO: 762 - protein, 1003 aa, unidentified; identical to SEQ ID NO: 717
  REGION 1..1003: note = Description of Unknown:uncultivated organism with predicted taxonomy: Collinsella
  REGION 1..1003: note = MG14-88 effector

SEQ ID NO: 763 - protein, 1002 aa, unidentified
  REGION 1..1002: note = Description of Unknown:uncultivated organism with predicted taxonomy: Collinsella
  REGION 1..1002: note = MG14-89 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHENGTSRALSATERDECIAILFSCEPIRDNEDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 764 - protein, 1003 aa, unidentified
  REGION 1..1003: note = Description of Unknown:uncultivated organism with predicted taxonomy: Coriobacteriia
  REGION 1..1003: note = MG14-90 effector
MEITINREIGKLGLPRHLVLGMDPGIASCGFALIDTANHEILDLGVRLFDSPTHPKTGQSLAVIRRGFRSTRRNIDRTQARLKRCLQVFKAYGLIPQDATKEYFHTTKGDKQPLKLRVDGLDRLLSAREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCPYFPTEKRAARCTLTSELVSAYGALGNITIIHENGTSRALSATEHDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEENRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENAMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGFDIDNANWSFSDRLTRKKLRSPTVNKLSNDLSPLVIRESPIR

SEQ ID NO: 765 - protein, 1026 aa, unidentified; identical to SEQ ID NO: 746
  REGION 1..1026: note = Description of Unknown:uncultivated organism with predicted taxonomy: Collinsellatanakaei
  REGION 1..1026: note = MG14-91 effector

SEQ ID NO: 766 - protein, 1004 aa, unidentified
  REGION 1..1004: note = Description of Unknown:uncultivated organism with predicted taxonomy: Collinsella
  REGION 1..1004: note = MG14-92 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLCRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTGKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 767 - protein, 1003 aa, unidentified
  REGION 1..1003: note = Description of Unknown:uncultivated organism with predicted taxonomy: Collinsella
  REGION 1..1003: note = MG14-93 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 768 - protein, 1003 aa, unidentified
  REGION 1..1003: note = Description of Unknown:uncultivated organism with predicted taxonomy: Collinsella
  REGION 1..1003: note = MG14-94 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGRGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 769 - protein, 1046 aa, unidentified
  REGION 1..1046: note = Description of Unknown:uncultivated organism with predicted taxonomy: Collinsella
  REGION 1..1046: note = MG14-95 effector
MDKAKGADIGELGFDPATFATALMTLEEFRSKDRVIWAGLDIGVASTGLCLVDVRNHEIVLMASHLFKSPVVDKKKATAAPESLASVRRGARSVRRNIMREGRRKKAIRAALADFDLIPADTDGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRELFDVKRSVKPLKWSGLRRRLGLAECDSFKGRPAEEEKRDCIALPAWAVLCSGLYENHRDLLERLHDHIDDADAVCSALTFASSAASLAGRLAPLAITDDEVEAIIDLPYSARLFSGYANASLEALQMLRGTFEDPHVTSLRQAEEDSGLAQARAMLAEERGGSADGLLCAFSDYDPTCRNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGAGIDFRRMLEEHGYAEIDHILPVSRTCDDSQANKALCLTKSNRDKSNRSPYEWMTSGEASAPDWGEFCGRMERWAKMCETRRYARKKLANLTCENLAERAGNFIDRNLNDTRYMSVALAKWLRECLPFTKDGHEHVFCVAGGATALMRSVWDIGITGPDGKKNRDDDRHHAVDAAVIACCTPGIVKNVALVNEGHARADVRQRLFSDSLPYPEFKEQVDAWISCIVPTLTLPNTVTGSVLKDTVYPYLGRDEAGKDLYITVKRDKDGRIVERKVNKATTMWKDGQGGCRAYGSMCALEAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAADVQME

SEQ ID NO: 770 - protein, 1002 aa, unidentified
  REGION 1..1002: note = Description of Unknown:uncultivated organism with predicted taxonomy: Collinsella
  REGION 1..1002: note = MG14-96 effector
MEITINREIGKLGLPRYLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEASYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENGCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDNRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 771 - protein, 1002 aa, unidentified
  REGION 1..1002: note = Description of Unknown:uncultivated organism with predicted taxonomy: Collinsella
  REGION 1..1002: note = MG14-97 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLNRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTLIRELLI

SEQ ID NO: 772 - protein, 1003 aa, unidentified
  REGION 1..1003: note = Description of Unknown:uncultivated organism with predicted taxonomy: Collinsella
  REGION 1..1003: note = MG14-98 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGCKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAANEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDDAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNEAQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKQPLEMYLGDLVQIGDFVGRFSGYNIDNANWSFVDRLTRIKISCPTVGKLSNDMSPFVVRESPIK

SEQ ID NO: 773 - protein, 1002 aa, unidentified; identical to SEQ ID NO: 685
  REGION 1..1002: note = Description of Unknown:uncultivated organism with predicted taxonomy: Olsenella
  REGION 1..1002: note = MG14-99 effector

SEQ ID NO: 774 - protein, 1004 aa, unidentified
  REGION 1..1004: note = Description of Unknown:uncultivated organism with predicted taxonomy: Collinsella
  REGION 1..1004: note = MG14-100 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLCDDRNLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 775 - protein, 1045 aa, unidentified
  REGION 1..1045: note = Description of Unknown:uncultivated organism with predicted taxonomy: Eggerthella sp.AM16-19
  REGION 1..1045: note = MG14-101 effector
MDKAQGVDIGELGFDPGTFATALMTLEEFRSKDRVIWAGIDIGVASTGLCLVDVRNHEIVLMTSHLFKSPVVDKKKATAAPESLASVRRGARSVRRNIMREGRRKKAIRAVLADSDLIPADADGEWFAARRDERTVVKLRSKALGHLLNSRELARVLYSFASHRGYIDHGKSDKDDDAGKVKKALAANHAALAGGGCETFGQYLAVQPRSRNRAGDYSFTSDIGMTVDEVRTIFLRQREMGSEIATEALEERYIAELTWLTDTSKRDMSTYLKVGFCTYRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLAPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFCVAGGATALMRSVWNIGITGPDGKKNRDDDRHHAVDAAVIACCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGCRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMPEDCLGLCWLSFLSNRAIAQMD

SEQ ID NO: 776 - protein, 1000 aa, unidentified
  REGION 1..1000: note = Description of Unknown:uncultivated organism with predicted taxonomy: Olsenella sp.KH3B4
  REGION 1..1000: note = MG14-102 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTAGEIDDYLKILFSTAPIKGNKECKVTYGTIRKDLDISGKSVFKGIAQDKEKDEPFAPKAWRSLRRVLPERLLASMLEDRNLGDAVCEALTFASSEASLIERLSDLDLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNLNDDRYMSVAVKNFLEDRLLFPEDGRKRHVTAVAGGATGNLRWVWGLNFGEGNIKDRTDDRHHAVDAAIIAACSESTVKKVAKASAKGREAFKQLRKSRLADTQPWPTFAAEVAARREFVVPTRMADHGVMGRVFKDTLYHLEGITEDKGKYPLVRAGEKTVKKGNVRINPDGSVKLIDGMAFLRLWLDPTARPNGKVKGKWYAEPVYYVDIPAIKAGAYVPRACTIHVARVNWKPVPEEAMQIEPIMLYAGDVVEINNRLVRYSGFDINGATLYYQSLLNGATTTAIPSLGTWGKDTQVRVLQEDCLGHCYDGIAINPEDSTFQQR

SEQ ID NO: 777 - protein, 1003 aa, unidentified
  REGION 1..1003: note = Description of Unknown:uncultivated organism with predicted taxonomy: Collinsella
  REGION 1..1003: note = MG14-103 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 778 - protein, 1003 aa, unidentified
  REGION 1..1003: note = Description of Unknown:uncultivated organism with predicted taxonomy: Collinsella
  REGION 1..1003: note = MG14-104 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQKPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICHKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHVPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 779 - protein, 1005 aa, unidentified; identical to SEQ ID NO: 695
  REGION 1..1005: note = Description of Unknown:uncultivated organism with predicted taxonomy: Collinsella
  REGION 1..1005: note = MG14-105 effector

SEQ ID NO: 780 - protein, 1003 aa, unidentified; identical to SEQ ID NO: 728
  REGION 1..1003: note = Description of Unknown:uncultivated organism with predicted taxonomy: Collinsella
  REGION 1..1003: note = MG14-106 effector

SEQ ID NO: 781 - protein, 965 aa, unidentified
  REGION 1..965: note = Description of Unknown:uncultivated organism with predicted taxonomy: Collinsella
  REGION 1..965: note = MG14-107 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNID

SEQ ID NO: 782 - protein, 1027 aa, unidentified
  REGION 1..1027: note = Description of Unknown:uncultivated organism with predicted taxonomy: Atopobium sp.ICM42b
  REGION 1..1027: note = MG14-108 effector
MSKSDRGLVFGIDLGKASCGLAIIDYEAKEVKLLSSRIIKAPENRSGKSLAAVRREKRSIRRQIDRRAARKKNVLKVLKQFGITPQDCDCKWFETKKNGNDGIDLPVIVLRSQGLDRQLSNREWARILYWFCSQRGYINRGEETLINGEVSTEVSSESEEAGKVLSAISENKKALKESGYRTFGEYLYKESYVSTRSYRNKAGDYKHCVSHPIVVDEIKELFEQQKKFGNTHTSEEFRDAYLEQLNWLKDTKAFDKLTYQKVGYCVYFDQYSDEPQKRAANADLISEVVKAYEKLGNIRLKFDDKPEQSLTREVRDAVINEMFSVHQGAKVKSVTYKTLRKLIDDDNLVGFKGVKSDLEKNPVFVPKAWNTFCRVLSASESGIQLLNRMKNDFKLANAIAESLTYASSLDSLERRISMYQEKESLEISEDELALIESLPYNIKIFKGYGSRSIQALEMLHDQFLGGKAFTLDEAEKQSGLQGFRLREKGIRQSLLLPYSDYDVQCTNPVVLRVLAQARRMINSAIKQYGMPNIIRIELGNDIAKSAKEKSKIAKGQNENRKENERIKDKIAKLLHIDQSEVTGKQITKMKLYEEQGGKDIYTGESLGDIAFAGGRRFLIDDNYCEIDHVLPYSRSADDLKSNKVLVLAKSNQEKGNRTPYEWMNSNDGNHPNWEQFCLRVTSNVRLSDSKKSKLLEENFAEKETSFIKRNMVDTQYMARAISAWLSDSLNFSSEFDQKQHVYAVNGRMTAKLRRKWGLNFGEDDTKDRSDNRHHAIDAAVIAACSASMVKEFAISYSRLREVRDSVIAEPWEGFADQVREAREWIIPTMYRPNKKNGLIYEETKYKYLGKEVGDKKIVHILKGKKQGVGTVDLFRDPTGGQFARILGDRAYIRLWLDEEGKSGRGEWLIEPVYFADLDKIKRGSYVPRYIPRQKVTTQEWESIPSRITENSIPIVLRNDDIVRIDGIYGRLSGLDINSKRLKFDRILSKDVKTIGSWTKDTSVEVIHEDCLGLMWFNLLKDQNSKES

SEQ ID NO: 783 - protein, 1031 aa, unidentified
  REGION 1..1031: note = Description of Unknown:uncultivated organism with predicted taxonomy: Atopobium sp.ICM42b
  REGION 1..1031: note = MG14-109 effector
MSKSDRGHVFGVDLGKSGNGLASIDYENKDINFLSSRPFKAPENRAGKSLAKVRREARSIRRQLDRKSTRKKQIIKVLKQFSVIAQECDSRWFETKKNGNGGIDLPIIILRSQGLDRKLTNREWARVLYWFCSQRGYINRGEEALSNEEASVEDSSESDEVGKVLSAISDNRKALKKSGYRTFGEYLFKESYEITRSYRNKNGEYRHCVSHPMVVDEINELFKHQQKLGNTYTSEEFREAYLRQLNWLKDTMAFDKLTYQKVGYCVYFDQYSDEPQKRAANADLISEVVKAYEKLGNIRLKFDDKSEQNLTKEVRDAVINEMFSIHQGSRVKSITYKTLRKLIDNENLIEFKGIKSDLEKSSVFAPKAWNFYCRALSISESGLQLLNRMKSDFKFANVISESLTYATSLESLESRILMYQDKESIEISEEELTLIESLPYNSKIFKGYGSRSIEALEMLYDQFTEGEAFTLDEAEKQSGLQSFRLRDKGIKQRLLPPYSDYDPQCTNPVVLRSLSQARKMINSGIKQFGMPDIIRVELAKELTKSPKQREKIAKEQNKNRKENERIRKEIAKYLEIDSSCVTKKQILKKKLYEEQKGLDVYTGESLEPSLHADDLTYLKDDSYCQIDHILPYSRSADDSIANKVLVLAKSNQDKGNRTPYEWMTSGHEHHLSWEEFAIRVSTNLSISDSKKWRLLEEDFNKKEVQFMNRNLSDTQYMSKAIVAWLSDSLDFPSRYGQKQHVYATNGRMTSKLRKEWGLNFGENGIKDRNDKRHHAVDAAVIAACSASMVKEFATSYSRSHETKNSTIAEPWEGFADQVREAREWVIPTMYRPNKKNGLLFEDRRYRYAGKTNKHILIGKEGKEKTSGNIRFFDNEKDGKHVKIVGDVAYIRLWLDVNAREGKGEWLIEPVYFADLQSIKKGTYIPKYIATYNATNDEWKPVPDDVLSKNKPLIVHRQDVIKVDSSFFRVNSVDIAKKTLKLIPVFYDSKNSNPELMITRKWDKSTKIELVYEDVLGMIWFNYLKNQNSSES

SEQ ID NO: 784 - protein, 1003 aa, unidentified; identical to SEQ ID NO: 717
  REGION 1..1003: note = Description of Unknown:uncultivated organism with predicted taxonomy: Collinsella
  REGION 1..1003: note = MG14-110 effector

SEQ ID NO: 785 - protein, 1037 aa, unidentified
  REGION 1..1037: note = Description of Unknown:uncultivated organism
  REGION 1..1037: note = MG14-111 effector
MEYSDPRDFGFRPETVMTALMPYEQFSSKTRRLILGIDMGIASVGVCLIDIRNHEIVLMASHIFKAPVEGKQKDISARQSGASIRRGYRSVRRTTKRRKNRKKAVRDIEKKYILIPDDADGQWFAIRKGEPDVLHLRGKALLYKLNGRELARILYAFADRRGYIDHGKGATDDDSGKVKKALSVNRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVASLFAVSKNPKPLKWSQLREKLDMQSSDSFDSRLPTDEKDDCIKIPAWNALCTGLFMSNRALLDRFHDDTDAADAVCSALTYASSGESLRNALENLSLDLSEQDIDSLLDLPYASKLFSGYCSAGVRALQMLRDAFKDPQIEKLYNAEKATGLYEARQALAAARNESRDGLLCPYLEFDPTCTNPVVLRATAQVRRMINSIIRHYGLPDIIRVEVAKDLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNLNDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 786 - protein, 1004 aa, unidentified
  REGION 1..1004: note = Description of Unknown:uncultivated organism with predicted taxonomy: Collinsella
  REGION 1..1004: note = MG14-112 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRGAIMKALESVMPWETFANEVRAAHGFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 787 - protein, 1002 aa, unidentified; identical to SEQ ID NO: 771
  REGION 1..1002: note = Description of Unknown:uncultivated organism with predicted taxonomy: Collinsella
  REGION 1..1002: note = MG14-113 effector

SEQ ID NO: 788 - protein, 1002 aa, unidentified
  REGION 1..1002: note = Description of Unknown:uncultivated organism with predicted taxonomy: Collinsella
  REGION 1..1002: note = MG14-114 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQEAHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 789 - protein, 1003 aa, unidentified
  REGION 1..1003: note = Description of Unknown:uncultivated organism with predicted taxonomy: Collinsella
  REGION 1..1003: note = MG14-115 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVVYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIEVSKMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 790 - protein, 1002 aa, unidentified
  REGION 1..1002: note = Description of Unknown:uncultivated organism with predicted taxonomy: Collinsella
  REGION 1..1002: note = MG14-116 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFETAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCAADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSDGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPSLKDGTYVPKIAKAATGRKAWKAIPQNVLNSAPLEIYLGDLVQIGNQKGRFRGINIATVSWSFVDTLSKLPVKMPTIGRLNNETIPTVIRELLI

SEQ ID NO: 791 - protein, 1003 aa, unidentified
  REGION 1..1003: note = Description of Unknown:uncultivated organism with predicted taxonomy: Collinsella
  REGION 1..1003: note = MG14-117 effector
MEITINREIGKLGLPRHLMLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDHLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNEDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPALKDGTYVPRIAKAHTGRKAWKPVPGSAMKKPPLEIYLGDLVQIGDFVGRFSGYNIDNANWSFVDRLTRIKISCPTVGKLSNDMSPFVVRESPIK

SEQ ID NO: 792 - protein, 1000 aa, unidentified
  REGION 1..1000: note = Description of Unknown:uncultivated organism with predicted taxonomy: Olsenella sp.KCTC 15699
  REGION 1..1000: note = MG14-118 effector
MDVTRPYLVLGLDPGIASCGFCLLDMTNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASQIDDYLKILFSTAPIKGNKECKVTYGTIRKDLDISGKSVFKGIAQDKEKDEPFVPKAWRSLRRVLPERLLARMLEDRNLGDAVCEALTFASSEASLIERLSDLGLSDDERDAILAVPFTGKLFKGYGSRSLKALGLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGHKRHVTAVAGGATGNLRWVWGLNFGEGNVKNRADDRHHAVDAAIIAACSESTVKKVAEASAKGREAFKQLRKSRLADTQPWPTFAAEVAARREFVVPTRMADHGVTGRVFEDTLYHLEGITEDKGKYPLVRAGKNTVKKGNVRINSDGSVKLIDGMAFLRLWLDPTARPNGKVKGKWYAEPVYYADIPAIKAGTYVPRAIVQGIARINWEPIPQMALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 793 - protein, 1005 aa, unidentified
  REGION 1..1005: note = Description of Unknown:uncultivated organism with predicted taxonomy: Collinsella
  REGION 1..1005: note = MG14-119 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRQLNDREWALVLYSLCKRRGYIPHGEGNQDKSSEGGKVLSALAANKEAIAETSCRTVGEWLAQQPQSRNRGGNYDKCGTHAQLIEETHILFDAQRSFGSKYASPEFEAAYIEVCDWERSRKDFDHRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 794 - protein, 1026 aa, unidentified
  REGION 1..1026: note = Description of Unknown:uncultivated organism with predicted taxonomy: Collinsellatanakaei
  REGION 1..1026: note = MG14-120 effector
MESLVNREVGGLGKPRYLVMGMDPGIKSCGFALLDLNNQEILEMGSRLFDAPTHPKTKQSMAVIRRGYRSTRRNIDRTQDRLKHCLKTLKRFDVVPEDADKEFFHTVKGDKQPILLRTDGLNRLLTSREWALVLYSLCKRRGYIPHGEGSDSGTSEDGKVLAALKANERAFADAGYRTVGEWLASLPQSRNRGGNYDKCVTHAQLTDEVRTLFEAQRGFGSPVASQELEDAYIEVFDWERSREEFDKRTYGLVGTCSYFPNEKRAARCTLTSEMVAAYGALGNITIVKRDGSTHPLSAVERDQCIDILFAVDPMKGNKTCAVKYGFLRKRLDLESGDYFKGVPLDDEKNREVFKPKGWRSLRSVLHETNRELLVKLHDDRDLADAVMEAVAYSSSVDVLKSQLSSLDLSNGEIESICAMPYSSKVLNGYGNRSKKALDILLGCFEDPDVLSLTDAEDASGLGAVRMQGAAIDKGERLIPYETWIALTGRTNNNPVVIRALSQMRKVVNAVCRKWGVPDEIHVELDRELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNMTDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRKGRGELYGQTVYSYLGVDESGKDLGRKKGSNKKIVMGNAVISKDGKSMVKISEMLCLRLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 795 - protein, 1004 aa, unidentified
  REGION 1..1004: note = Description of Unknown:uncultivated organism with predicted taxonomy: Collinsella
  REGION 1..1004: note = MG14-121 effector
MEITINREIGKLGLPRHLVLGMDPGIESCGFALIDTANHEILNLGVRLFDSPTHPKPGQSLAVIRRGFRSTRRNIDRTQARLKHCLQVLKAYDLIPQDATKEYFHTTKGDKQPLKLRVDGLDRLLNDREWALVLYSLCKRRGYIPHGEGNQDKSSEGGKVLSALAANKEAIAETSCHTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSAMERDECIAILFSCEPIRGNKDCAVKFGALRKALDLSSGDYFKGIPAADEKTREVYKPKGWRVLRNTLNAANPILLQRLRDDRDLADAVMEAVAYSSALPVLQKQLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNKKNRERIAGQIAELRGCTIDEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSFTDTAYMSREVCAYLADCLLFPDDGAKAHVVPTTGRATAWLRRRWGLNFGSNGEKDRLDDRHHATDACVIAACSRSLVIKTARINQETHWSITRGMNEAQRRDAIMKALESVMPWETFANEVRAAHDFVVPTRFVPRKGKGKLFEQTVYRYAGVNAQGKDIARKASSDKDIVMGNAVVSADEKSVIKVSEMLCLRLWHDPEAKKGQGAWYADPVYKADIPALKDGTYVPRIAKQNYGRKVWKAIPHSLLIQKPLEIYLGDLIRVGDKLGRYNGYNIAKANWSFVDALTKKEITFPSVGMLSNELRPIVIRESILDN

SEQ ID NO: 796 - protein, 1002 aa, unidentified
  REGION 1..1002: note = Description of Unknown:uncultivated organism with predicted taxonomy: Olsenella
  REGION 1..1002: note = MG14-122 effector
MDVTRPYLVLGLDPGIASCGFCLLDMTNHKILEMGSHLFKAPQEDKTKTSLAVTRRKARSIRRNTARTAARLKRCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKVLFASQRAHGNTKATRELEDSYLACLTWEKKSLDHDARVYELVGPCSYFPGEKRAASADISSELCRAYERLGHIVIVHEDGSEQALTASEIDDHLKILFSTAPIKGNKECKVTYGTIRKDLDISGKSVFKGIAQDREKDEPFAPKAWRSLRRVLPEGLLARMFADRKLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANHLNTDLGPETQAKFLARNLNDDRYMSVAVKNYLEDCLLFPEDGRKRHVTAVAGGATGNLRWVWGLNFGEGNVKDRADDRHHAVDAAIIAACSESTVKKVAEASAKGREAFKQLRKSRLADTQPWPTFAAEVAARREFVVPTRMADHGVTGRAFQDFSYRLEGLRETGYAEISRQTDPATRERRSDAAGNYALSSNGTVKLLDAIAFVRFWHDPDAGKNGKWYAEPVYCADIPAIQNGSYVPKYQKQKVARNSWLPVPDSAMHNEPLVLFQGDVLIIDSHIGRFWTYAIGGGTLNILSLLDKNEKAECFPPISKWVNSVEVRVLQEDCLGHCYDDISINPEDSTFRQR

SEQ ID NO: 797 - protein, 1003 aa, unidentified
  REGION 1..1003: note = Description of Unknown:uncultivated organism with predicted taxonomy: Olsenellamediterranea
  REGION 1..1003: note = MG14-123 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKHASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKTSSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 798 - protein, 1005 aa, unidentified
  REGION 1..1005: note = Description of Unknown:uncultivated organism with predicted taxonomy: Collinsella
  REGION 1..1005: note = MG14-124 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVTYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 799 - protein, 1003 aa, unidentified
  REGION 1..1003: note = Description of Unknown:uncultivated organism with predicted taxonomy: Collinsella
  REGION 1..1003: note = MG14-125 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALADNKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKVEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVITVREMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 800 - protein, 969 aa, unidentified
  REGION 1..969: note = Description of Unknown:uncultivated organism with predicted taxonomy: Libanicoccusmassiliensis
  REGION 1..969: note = MG14-126 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKC

SEQ ID NO: 801 - protein, 1003 aa, unidentified
  REGION 1..1003: note = Description of Unknown:uncultivated organism with predicted taxonomy: Collinsella
  REGION 1..1003: note = MG14-127 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 802 - protein, 1003 aa, unidentified
  REGION 1..1003: note = Description of Unknown:uncultivated organism with predicted taxonomy: Collinsella
  REGION 1..1003: note = MG14-128 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALVANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 803 - protein, 1003 aa, unidentified; identical to SEQ ID NO: 799
  REGION 1..1003: note = Description of Unknown:uncultivated organism with predicted taxonomy: Collinsella
  REGION 1..1003: note = MG14-129 effector

SEQ ID NO: 804 - protein, 753 aa, unidentified
  REGION 1..753: note = Description of Unknown:uncultivated organism with predicted taxonomy: Olsenella sp.KH3B4
  REGION 1..753: note = MG14-130 effector
MDVTRSYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKK

SEQ ID NO: 805 - protein, 985 aa, unidentified
  REGION 1..985: note = Description of Unknown:uncultivated organism with predicted taxonomy: Collinsella
  REGION 1..985: note = MG14-131 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRMAKPPLEIYFDDLVQIGDFIERFSGYNINSANWSFTDRLTRLNLSCPTVGQLNNDLSPVVIRESPIK

SEQ ID NO: 806 - protein, 1003 aa, unidentified
  REGION 1..1003: note = Description of Unknown:uncultivated organism with predicted taxonomy: Collinsella
  REGION 1..1003: note = MG14-132 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCKLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLINDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 807 - protein, 1004 aa, unidentified
  REGION 1..1004: note = Description of Unknown:uncultivated organism with predicted taxonomy: Collinsella
  REGION 1..1004: note = MG14-133 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 808 - protein, 1003 aa, unidentified; identical to SEQ ID NO: 712
  REGION 1..1003: note = Description of Unknown:uncultivated organism with predicted taxonomy: Collinsella
  REGION 1..1003: note = MG14-135 effector

SEQ ID NO: 809 - protein, 1004 aa, unidentified
  REGION 1..1004: note = Description of Unknown:uncultivated organism with predicted taxonomy: Collinsella
  REGION 1..1004: note = MG14-136 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDCSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 810 - protein, 1024 aa, unidentified
  REGION 1..1024: note = Description of Unknown:uncultivated organism with predicted taxonomy: Clostridiales
  REGION 1..1024: note = MG14-137 effector
MMEYSDPRDFGFRPETVMTALMPYEQFSSKTRRLILGIDMGIASVGVCLIDIRNHEIVLMASHIFKAPVEGKQKDISARQSGASIRRGYRSVRRTTKRRKNRKKAVRDIEKKYILIPDDADGQWFAIRKGEPDVLHLRGKALLYKLNGRELARILYAFAGRRGYIDHGKGATDDDSGKVKKALSVNRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVASLFAVSKNPKPLKWSQLREKLDMQSSDSFDSRLPTDEKDDCIKIPAWNALCTGLFMSNRALLDRFHDDTDAADAVCSALTYASSGGSLRNALENLSLDLSEQDIDSLLDLPYASKLFSGYCSAGVRALQMLRDAFKDPQIEKLYNAEKATGLYEARQALAAARNESRDGLLCPYLEFDPTCTNPVVLRATAQVRRMINSIIRHYGLPDIIRVEVAKDLKRSKREKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNLNDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLK

SEQ ID NO: 811 - protein, 1003 aa, unidentified
  REGION 1..1003: note = Description of Unknown:uncultivated organism with predicted taxonomy: Collinsella
  REGION 1..1003: note = MG14-138 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKLRGYVPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 812 - protein, 1003 aa, unidentified
  REGION 1..1003: note = Description of Unknown:uncultivated organism with predicted taxonomy: Collinsella
  REGION 1..1003: note = MG14-139 effector
MEITINREIGKLGLPRHLVLGMDPGIASCGFALIDTANHEILDLGVRLFDSPTHPKTGQSLAVIRRGFRSARRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 813 - protein, 1003 aa, unidentified
  REGION 1..1003: note = Description of Unknown:uncultivated organism with predicted taxonomy: Collinsella
  REGION 1..1003: note = MG14-140 effector
MEITINREIGKLELPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 814 - protein, 1000 aa, unidentified; identical to SEQ ID NO: 730
  REGION 1..1000: note = Description of Unknown:uncultivated organism with predicted taxonomy: Olsenella sp.KH3B4
  REGION 1..1000: note = MG14-141 effector

SEQ ID NO: 815 - protein, 1004 aa, unidentified
  REGION 1..1004: note = Description of Unknown:uncultivated organism with predicted taxonomy: Collinsella
  REGION 1..1004: note = MG14-142 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPNLLQRLRDDRDLADAVMEAVAYSSALPVLQERLQGLPLSEAEIEALCMLPYSSKVLNGYGNRSKKALDMLLDCLEEPEVLNLTQGENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 816 - protein, 1005 aa, unidentified; identical to SEQ ID NO: 798
  REGION 1..1005: note = Description of Unknown:uncultivated organism with predicted taxonomy: Collinsella
  REGION 1..1005: note = MG14-143 effector

SEQ ID NO: 817 - protein, 1045 aa, unidentified
  REGION 1..1045: note = Description of Unknown:uncultivated organism with predicted taxonomy: Collinsella
  REGION 1..1045: note = MG14-144 effector
MDKAQGVDIGELGFDPGTFATALMTLEEFRSKDRVIWAGIDIGVASTGLCLVDVRNHEIVLMTSHLFKSPVVDKKKATAAPESLASVRRGARSVRRNIMREGRRKKAIRAVLADSDLIPADADGEWFAARRDERTVVKLRSKALGHLLNSRELARVLYSFASHRGYIDHGKSDKDDDAGKVKKALAANHAALAGGGCETFGQYLAGQPRSRNRAGDYSFTSDIGMTVDEVRTIFLRQREMGSEIATEALEERYIAELTWLTDTSKRDMSTYLKVGFCTYRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLAPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFCVAGGATALMRSVWDIGITGPDGKKNRDDDRHHAVDAAVIACCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGCRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 818 - protein, 1000 aa, unidentified
  REGION 1..1000: note = Description of Unknown:uncultivated organism with predicted taxonomy: Olsenella sp.KCTC 15699
  REGION 1..1000: note = MG14-145 effector
MDVTRPYLVLGLDPGIASCGFCLLDMTNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 819 - protein, 1000 aa, unidentified
  REGION 1..1000: note = Description of Unknown:uncultivated organism with predicted taxonomy: Olsenella
  REGION 1..1000: note = MG14-146 effector
MDTTRPYLVLGLDPGIASCGFCLLDMTNHKILEMGSHLFKAPQEDKTKTSLAVTRRKARSIRRNTARTAARLKHCLELLAGAGLVQADADKPWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGTEQALTAGEINDYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLGLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSCTCDDSRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFAAEVAARREFVVPTHMANHGVTGRVFEDTLYHLEGITEDKGKYPLVRAGEKTVKKGNVRINPDGSVKLIDGMAFLRLWLDPTARPNGKVKGKWYAEPVYYADIPAIKAGTYVPRACTIHVARVNWEPVPEAAMELEPVVLYAGDVVEINNQLVRYSGFNINGATLYYQSLLNGATTTAIPSLGTWGKDTQVRVLQEDCLGHCYDGILINPEDSTFQKR

SEQ ID NO: 820 - protein, 1002 aa, unidentified; identical to SEQ ID NO: 711
  REGION 1..1002: note = Description of Unknown:uncultivated organism with predicted taxonomy: Olsenella sp.KH3B4
  REGION 1..1002: note = MG14-147 effector

SEQ ID NO: 821 - protein, 828 aa, unidentified
  REGION 1..828: note = Description of Unknown:uncultivated organism with predicted taxonomy: Olsenellamediterranea
  REGION 1..828: note = MG14-148 effector
LIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPIVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIV

SEQ ID NO: 822 - protein, 1003 aa, unidentified
  REGION 1..1003: note = Description of Unknown:uncultivated organism with predicted taxonomy: Collinsella
  REGION 1..1003: note = MG14-149 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDCEWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGISRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 823 - protein, 863 aa, unidentified
  REGION 1..863: note = Description of Unknown:uncultivated organism with predicted taxonomy: Collinsella
  REGION 1..863: note = MG14-150 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRDNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACNRSLVIKTARINQETHWSITRGMNETQRRDAIMKALESVMPWETFANEVRAAHDFVVPTRFVPRKGKGELFEQTVYRYAGVNAQGKDIARKASSDKDIVMGN

SEQ ID NO: 824 - protein, 1003 aa, unidentified; identical to SEQ ID NO: 822
  REGION 1..1003: note = Description of Unknown:uncultivated organism with predicted taxonomy: Collinsella
  REGION 1..1003: note = MG14-151 effector

SEQ ID NO: 825 - protein, 1005 aa, unidentified; identical to SEQ ID NO: 688
  REGION 1..1005: note = Description of Unknown:uncultivated organism with predicted taxonomy: Collinsella
  REGION 1..1005: note = MG14-152 effector

SEQ ID NO: 826 - protein, 1005 aa, unidentified; identical to SEQ ID NO: 695
  REGION 1..1005: note = Description of Unknown:uncultivated organism with predicted taxonomy:Coriobacteriales
  REGION 1..1005: note = MG14-153 effector

SEQ ID NO: 827 - protein, 1000 aa, unidentified; identical to SEQ ID NO: 733
  REGION 1..1000: note = Description of Unknown:uncultivated organism with predicted taxonomy: Olsenella
  REGION 1..1000: note = MG14-154 effector

SEQ ID NO: 828 - protein, 1000 aa, unidentified; identical to SEQ ID NO: 710
  REGION 1..1000: note = Description of Unknown:uncultivated organism with predicted taxonomy: Olsenella
  REGION 1..1000: note = MG14-155 effector

SEQ ID NO: 829 - protein, 1024 aa, unidentified
  REGION 1..1024: note = Description of Unknown:uncultivated organism with predicted taxonomy: Libanicoccusmassiliensis
  REGION 1..1024: note = MG14-156 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 830 - protein, 1003 aa, unidentified
  REGION 1..1003: note = Description of Unknown:uncultivated organism with predicted taxonomy: Collinsella
  REGION 1..1003: note = MG14-157 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 831 - protein, 1005 aa, unidentified; identical to SEQ ID NO: 693
  REGION 1..1005: note = Description of Unknown:uncultivated organism with predicted taxonomy: Collinsella
  REGION 1..1005: note = MG14-158 effector

SEQ ID NO: 832 - protein, 1003 aa, unidentified; identical to SEQ ID NO: 768
  REGION 1..1003: note = Description of Unknown:uncultivated organism with predicted taxonomy: Collinsella
  REGION 1..1003: note = MG14-159 effector

SEQ ID NO: 833 - protein, 1003 aa, unidentified; identical to SEQ ID NO: 732
  REGION 1..1003: note = Description of Unknown:uncultivated organism with predicted taxonomy: Collinsella
  REGION 1..1003: note = MG14-160 effector

SEQ ID NO: 834 - protein, 1003 aa, unidentified; identical to SEQ ID NO: 732
  REGION 1..1003: note = Description of Unknown:uncultivated organism with predicted taxonomy: Collinsella
  REGION 1..1003: note = MG14-161 effector

SEQ ID NO: 835 - protein, 1002 aa, unidentified; identical to SEQ ID NO: 701
  REGION 1..1002: note = Description of Unknown:uncultivated organism with predicted taxonomy: Olsenella
  REGION 1..1002: note = MG14-162 effector

SEQ ID NO: 836 - protein, 1003 aa, unidentified; identical to SEQ ID NO: 732
  REGION 1..1003: note = Description of Unknown:uncultivated organism with predicted taxonomy: Collinsella
  REGION 1..1003: note = MG14-163 effector

SEQ ID NO: 837 - protein, 1000 aa, unidentified; identical to SEQ ID NO: 684
  REGION 1..1000: note = Description of Unknown:uncultivated organism with predicted taxonomy: Olsenella
  REGION 1..1000: note = MG14-164 effector

SEQ ID NO: 838 - protein, 1005 aa, unidentified; identical to SEQ ID NO: 688
  REGION 1..1005: note = Description of Unknown:uncultivated organism with predicted taxonomy: Collinsella
  REGION 1..1005: note = MG14-165 effector

SEQ ID NO: 839 - protein, 1003 aa, unidentified; identical to SEQ ID NO: 755
  REGION 1..1003: note = Description of Unknown:uncultivated organism with predicted taxonomy: Collinsella sp.AM17-1
  REGION 1..1003: note = MG14-166 effector

SEQ ID NO: 840 - protein, 1003 aa, unidentified; identical to SEQ ID NO: 717
  REGION 1..1003: note = Description of Unknown:uncultivated organism with predicted taxonomy: Collinsella
  REGION 1..1003: note = MG14-167 effector

SEQ ID NO: 841 - protein, 1000 aa, unidentified; identical to SEQ ID NO: 694
  REGION 1..1000: note = Description of Unknown:uncultivated organism with predicted taxonomy: Olsenella sp.KH3B4
  REGION 1..1000: note = MG14-168 effector

SEQ ID NO: 842 - protein, 1000 aa, unidentified
  REGION 1..1000: note = Description of Unknown:uncultivated organism with predicted taxonomy: Olsenella
  REGION 1..1000: note = MG14-169 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLVERLSDLDLSGDKQDAILTVPFTAKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 843 - protein, 839 aa, unidentified; identical to SEQ ID NO: 708
  REGION 1..839: note = Description of Unknown:uncultivated organism with predicted taxonomy: Olsenella sp.KH3B4
  REGION 1..839: note = MG14-170 effector

SEQ ID NO: 844 - protein, 1001 aa, unidentified; identical to SEQ ID NO: 707
  REGION 1..1001: note = Description of Unknown:uncultivated organism with predicted taxonomy: Coriobacteriiabacterium
  REGION 1..1001: note = MG14-171 effector

SEQ ID NO: 845 - protein, 1003 aa, unidentified; identical to SEQ ID NO: 740
  REGION 1..1003: note = Description of Unknown:uncultivated organism with predicted taxonomy: Collinsella
  REGION 1..1003: note = MG14-172 effector

SEQ ID NO: 846 - protein, 1003 aa, unidentified; identical to SEQ ID NO: 749
  REGION 1..1003: note = Description of Unknown:uncultivated organism with predicted taxonomy: Collinsella
  REGION 1..1003: note = MG14-173 effector

SEQ ID NO: 847 - protein, 856 aa, unidentified
  REGION 1..856: note = Description of Unknown:uncultivated organism with predicted taxonomy: Collinsella
  REGION 1..856: note = MG14-174 effector
EGSQDKSSEGGKVLSALAANKKALAETPCRTVGEWFAQQPQSRNRGGNYDKCVTHAQLIDETHILFEAQRSFGSAFASPEFEAAYIEVCDWERSRKDFDRRSYDLVGRCSYFPAEKRAARCTLTSELVAAYGALGNITIIHEGGTSRALSATERDECIAILFSCEPIRGNKDCAVKFGALRKALDLSSGDYFKGVPAADEKTREVYKPKGWRTLRNTLNAANPILLQRLRDDRDLADAVMEAVAYSSALPVLQEQLQELPLSEAEIEALCKLPYSSKTLNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSIIRGMNETQRRDAIMKALESVMPWETFANEVRVAHDFVVPTRFVPRKGKGELFEQTVYRYAGVNAQGKDIAHKASSDKDIVMGNAVVSADEKSVIKVSEMLCLRLWHDPKAKKGQGAWYADPVYKADIPALKDGTYVPRIAKAHTGRKAWKPVPESATKKPPLEIYLGDLVQIGDFVGRFSGYNIDNANWSFVDRLTRIKTSCPTVGKLSNDMSPFVVRESPIK

SEQ ID NO: 848 - protein, 1003 aa, unidentified; identical to SEQ ID NO: 714
  REGION 1..1003: note = Description of Unknown:uncultivated organism with predicted taxonomy: Collinsella
  REGION 1..1003: note = MG14-175 effector

SEQ ID NO: 849 - protein, 1003 aa, unidentified; identical to SEQ ID NO: 714
  REGION 1..1003: note = Description of Unknown:uncultivated organism with predicted taxonomy: Collinsellaaerofaciens
  REGION 1..1003: note = MG14-176 effector

SEQ ID NO: 850 - protein, 1003 aa, unidentified; identical to SEQ ID NO: 734
  REGION 1..1003: note = Description of Unknown:uncultivated organism with predicted taxonomy: Collinsella
  REGION 1..1003: note = MG14-177 effector

SEQ ID NO: 851 - protein, 1000 aa, unidentified
  REGION 1..1000: note = Description of Unknown:uncultivated organism with predicted taxonomy: Olsenella sp.GAM18
  REGION 1..1000: note = MG14-178 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGHRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHTVIVHEDGSEQALTAGEIDGYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLDLSDDERDAILTVPFTGKLFKGYGSRSLKALGLLLGAFEEPEIRILTDAEKVTGLLDLRLSDRDVRGQLLPPYSSYDPTCRNPVVLRAMGRMRHIVNAIFRIHGIPDEIHIELGRDLKMSNKEKILVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNLNDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFATEVAARREFVVPTRMADHGVTGRVFEDTLYHLEGIAEGKGKYPLVRASEKTVKKGNVRINPDGSVKLIDGMAFLRLWLDPTARPNGKVKGKWYAEPVYYADIPAIKAGTYVPRACTIHVARVNWEPVPEAAMGANPVIVFFGDVLSVDNHVGRFGGFDIFGGRLALLNLLTKQEVSDWPSLGSWGKDTQVRVLQEDCLGHCYDSIAINPEGSTFQQR

SEQ ID NO: 852 - protein, 1003 aa, unidentified; identical to SEQ ID NO: 718
  REGION 1..1003: note = Description of Unknown:uncultivated organism with predicted taxonomy: Collinsella
  REGION 1..1003: note = MG14-179 effector

SEQ ID NO: 853 - protein, 1003 aa, unidentified; identical to SEQ ID NO: 791
  REGION 1..1003: note = Description of Unknown:uncultivated organism with predicted taxonomy: Collinsella
  REGION 1..1003: note = MG14-180 effector

SEQ ID NO: 854 - protein, 1000 aa, unidentified; identical to SEQ ID NO: 745
  REGION 1..1000: note = Description of Unknown:uncultivated organism with predicted taxonomy: Olsenella
  REGION 1..1000: note = MG14-181 effector

SEQ ID NO: 855 - protein, 1003 aa, unidentified; identical to SEQ ID NO: 797
  REGION 1..1003: note = Description of Unknown:uncultivated organism with predicted taxonomy: Olsenellamediterranea
  REGION 1..1003: note = MG14-182 effector

SEQ ID NO: 856 - protein, 1002 aa, unidentified; identical to SEQ ID NO: 788
  REGION 1..1002: note = Description of Unknown:uncultivated organism with predicted taxonomy: Collinsella
  REGION 1..1002: note = MG14-183 effector

SEQ ID NO: 857 - protein, 1002 aa, unidentified; identical to SEQ ID NO: 796
  REGION 1..1002: note = Description of Unknown:uncultivated organism with predicted taxonomy: Olsenella
  REGION 1..1002: note = MG14-184 effector

SEQ ID NO: 858 - protein, 1003 aa, unidentified; identical to SEQ ID NO: 752
  REGION 1..1003: note = Description of Unknown:uncultivated organism with predicted taxonomy: Collinsella
  REGION 1..1003: note = MG14-185 effector

SEQ ID NO: 859 - protein, 1002 aa, unidentified; identical to SEQ ID NO: 770
  REGION 1..1002: note = Description of Unknown:uncultivated organism with predicted taxonomy: Collinsella
  REGION 1..1002: note = MG14-186 effector

SEQ ID NO: 860 - protein, 1003 aa, unidentified; identical to SEQ ID NO: 764
  REGION 1..1003: note = Description of Unknown:uncultivated organism with predicted taxonomy:Coriobacteriales
  REGION 1..1003: note = MG14-187 effector

SEQ ID NO: 861 - protein, 1003 aa, unidentified; identical to SEQ ID NO: 806
  REGION 1..1003: note = Description of Unknown:uncultivated organism with predicted taxonomy: Collinsella
  REGION 1..1003: note = MG14-188 effector

SEQ ID NO: 862 - protein, 1003 aa, unidentified; identical to SEQ ID NO: 717
  REGION 1..1003: note = Description of Unknown:uncultivated organism with predicted taxonomy: Collinsella
  REGION 1..1003: note = MG14-189 effector

SEQ ID NO: 863 - protein, 1003 aa, unidentified
  REGION 1..1003: note = Description of Unknown:uncultivated organism with predicted taxonomy: Collinsella
  REGION 1..1003: note = MG14-190 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 864 - protein, 1003 aa, unidentified; identical to SEQ ID NO: 802
  REGION 1..1003: note = Description of Unknown:uncultivated organism with predicted taxonomy: Collinsella
  REGION 1..1003: note = MG14-191 effector

SEQ ID NO: 865 - protein, 1003 aa, unidentified; identical to SEQ ID NO: 760
  REGION 1..1003: note = Description of Unknown:uncultivated organism with predicted taxonomy: Collinsella
  REGION 1..1003: note = MG14-192 effector

SEQ ID NO: 866 - protein, 1003 aa, unidentified; identical to SEQ ID NO: 777
  REGION 1..1003: note = Description of Unknown:uncultivated organism with predicted taxonomy: Collinsella
  REGION 1..1003: note = MG14-193 effector

SEQ ID NO: 867 - protein, 1004 aa, unidentified; identical to SEQ ID NO: 729
  REGION 1..1004: note = Description of Unknown:uncultivated organism with predicted taxonomy: Olsenella
  REGION 1..1004: note = MG14-194 effector

SEQ ID NO: 868 - protein, 1003 aa, unidentified; identical to SEQ ID NO: 714
  REGION 1..1003: note = Description of Unknown:uncultivated organism with predicted taxonomy: Collinsella
  REGION 1..1003: note = MG14-195 effector

SEQ ID NO: 869 - protein, 1046 aa, unidentified; identical to SEQ ID NO: 739
  REGION 1..1046: note = Description of Unknown:uncultivated organism with predicted taxonomy: Collinsella
  REGION 1..1046: note = MG14-196 effector

SEQ ID NO: 870 - protein, 1003 aa, unidentified; identical to SEQ ID NO: 801
  REGION 1..1003: note = Description of Unknown:uncultivated organism with predicted taxonomy: Collinsella
  REGION 1..1003: note = MG14-197 effector

SEQ ID NO: 871 - protein, 1003 aa, unidentified
  REGION 1..1003: note = Description of Unknown:uncultivated organism with predicted taxonomy: Collinsella
  REGION 1..1003: note = MG14-198 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPALKDGTYVPRIAKAHTGRKAWKPVPGSAMKKPPLEIYPGDLVQIGDFVGRFSGYNIDNANWSFVDRLTRIKISCPTVGKLSNDMSPFVVRESPIK

SEQ ID NO: 872 - protein, 862 aa, unidentified; identical to SEQ ID NO: 747
  REGION 1..862: note = Description of Unknown:uncultivated organism with predicted taxonomy: Collinsella
  REGION 1..862: note = MG14-199 effector

SEQ ID NO: 873 - protein, 833 aa, unidentified; identical to SEQ ID NO: 721
  REGION 1..833: note = Description of Unknown:uncultivated organism with predicted taxonomy: Collinsella
  REGION 1..833: note = MG14-200 effector

SEQ ID NO: 874 - protein, 1003 aa, unidentified; identical to SEQ ID NO: 813
  REGION 1..1003: note = Description of Unknown:uncultivated organism with predicted taxonomy: Collinsella
  REGION 1..1003: note = MG14-201 effector

SEQ ID NO: 875 - protein, 1003 aa, unidentified; identical to SEQ ID NO: 799
  REGION 1..1003: note = Description of Unknown:uncultivated organism with predicted taxonomy: Collinsella
  REGION 1..1003: note = MG14-202 effector

SEQ ID NO: 876 - protein, 1003 aa, unidentified; identical to SEQ ID NO: 799
  REGION 1..1003: note = Description of Unknown:uncultivated organism with predicted taxonomy: Collinsella
  REGION 1..1003: note = MG14-203 effector

SEQ ID NO: 877 - protein, 1003 aa, unidentified
  REGION 1..1003: note = Description of Unknown:uncultivated organism with predicted taxonomy: Collinsella
  REGION 1..1003: note = MG14-204 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPIVGQLNNDLSPVVIRESPIK

SEQ ID NO: 878 - protein, 958 aa, unidentified
  REGION 1..958: note = Description of Unknown:uncultivated organism with predicted taxonomy: Olsenellamediterranea
  REGION 1..958: note = MG14-205 effector
MEITINREIGKLGLPRHLVLGMDPGIASCGFALIDTANHEILDLGVRLFDSPTHPKTGQSLAVIRRGFRSTRRNNDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTNELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQSVLNSAPLEIYLGDLVQIGNQKGR

SEQ ID NO: 879 - protein, 762 aa, unidentified
  REGION 1..762: note = Description of Unknown:uncultivated organism with predicted taxonomy: Collinsella
  REGION 1..762: note = MG14-206 effector
MEITINREIGKLGLPRHLVLGMDPGIASCGFALIDTANHEILDLGVRLFDSPTHPKTGQSLAVIRRGFRSTRRNNDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHACHRCLCDCSM

SEQ ID NO: 880 - protein, 1004 aa, unidentified; identical to SEQ ID NO: 809
  REGION 1..1004: note = Description of Unknown:uncultivated organism with predicted taxonomy: Collinsella
  REGION 1..1004: note = MG14-207 effector

SEQ ID NO: 881 - protein, 1000 aa, unidentified; identical to SEQ ID NO: 776
  REGION 1..1000: note = Description of Unknown:uncultivated organism with predicted taxonomy: Olsenella
  REGION 1..1000: note = MG14-208 effector

SEQ ID NO: 882 - protein, 1003 aa, unidentified; identical to SEQ ID NO: 738
  REGION 1..1003: note = Description of Unknown:uncultivated organism with predicted taxonomy: Collinsella
  REGION 1..1003: note = MG14-209 effector

SEQ ID NO: 883 - protein, 1004 aa, unidentified; identical to SEQ ID NO: 754
  REGION 1..1004: note = Description of Unknown:uncultivated organism with predicted taxonomy: Collinsella
  REGION 1..1004: note = MG14-210 effector

SEQ ID NO: 884 - protein, 1002 aa, unidentified; identical to SEQ ID NO: 715
  REGION 1..1002: note = Description of Unknown:uncultivated organism with predicted taxonomy: Collinsella
  REGION 1..1002: note = MG14-211 effector

SEQ ID NO: 885 - protein, 1046 aa, unidentified; identical to SEQ ID NO: 769
  REGION 1..1046: note = Description of Unknown:uncultivated organism with predicted taxonomy: Collinsella
  REGION 1..1046: note = MG14-212 effector

SEQ ID NO: 886 - protein, 1002 aa, unidentified; identical to SEQ ID NO: 771
  REGION 1..1002: note = Description of Unknown:uncultivated organism with predicted taxonomy: Collinsella
  REGION 1..1002: note = MG14-213 effector

SEQ ID NO: 887 - protein, 1002 aa, unidentified; identical to SEQ ID NO: 771
  REGION 1..1002: note = Description of Unknown:uncultivated organism with predicted taxonomy:Coriobacteriales
  REGION 1..1002: note = MG14-214 effector

SEQ ID NO: 888 - protein, 798 aa, unidentified
  REGION 1..798: note = Description of Unknown:uncultivated organism with predicted taxonomy: Olsenella
  REGION 1..798: note = MG14-215 effector
MELVKPYYVLGLDLGPASCGFALIDINNMRILEIGSHLFDAPQENKKQTKVSLAAKRRSARSARRNNQRTKNRQKHCIKLLREAKLIPQDASGVWFQTKKGDRPSLKLRDRGLEERLSDREFAQILYTLSARRGYIPHGEGKLGYSKESSDSDLGKVLKAVSENSNALSNGKSRTVGELLYERGSSRNTAGAYDHCVLNSQIVEEVHALFKAQRDFGNDKASEQLENDYIANLTWEKKTLDIDAASYARVGFCTYFEEEKRAARADYSSELCAAYERLGHLTIVDSDGTETRLDPSRRNRYLSILFSPKALPKNKYCKVRYSDIRRDLDLSSDSAFKGVEADQEKDKEPFEPKAWRCMRENGISENLLERMLSDRDFADAIGEALTYASTKDSLLNQLDTVDLTSAEKESIAGLPFSSKIFKGYGNRSLKALYMLLDAFEDPDILTLADAETATGLKGKRLADNYQRSAFLPLYEIYDNDCNNPVVLRAMSRMRRIVNAIIKIYGVPDEIHIELARELKQSKREKDAISKFQRKKEQANNRYREVAAGILNISPDEVSDRIIEKMAFREQQNDKDAYTGTTINLERLVTDSHYCQVDHVLPYSRTSDNSRNNRVLVLSTTNQNKRERTPFEWMNSGEANAPAWNDYKKHVLANKNYSQRKKQVYLLNENLDSETEAQFISRNLNDTRYMSRATMAFLADTLEYPDDGRKRHVIAVAGSATSALRHVWGLNFGEGNVKDRSDDRHHAVDACVIAACSESTLKKVARARSRGYRSFKKTQESRLSDTQPWPTFADDVIAM

SEQ ID NO: 889 - protein, 1005 aa, unidentified; identical to SEQ ID NO: 744
  REGION 1..1005: note = Description of Unknown:uncultivated organism with predicted taxonomy: Collinsella
  REGION 1..1005: note = MG14-216 effector

SEQ ID NO: 890 - protein, 1004 aa, unidentified; identical to SEQ ID NO: 737
  REGION 1..1004: note = Description of Unknown:uncultivated organism with predicted taxonomy: Collinsella
  REGION 1..1004: note = MG14-217 effector

SEQ ID NO: 891 - protein, 769 aa, unidentified
  REGION 1..769: note = Description of Unknown:uncultivated organism with predicted taxonomy: Olsenellamediterranea
  REGION 1..769: note = MG14-218 effector
AAFGALPPKASARRTYDLVGHCSYFPTEKRAARCTLTSELVSAYGALGNITIIHENGTSRALSATERDECIAILFSCEPIRDNKDCAVKFGALRKALDLSSGDYFKGVPAADEKTREVYKPKGWRVLRNTLNATNPILLQRLRDDRDLADAVMEAVAYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLSFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 892 - protein, 1003 aa, unidentified; identical to SEQ ID NO: 767
  REGION 1..1003: note = Description of Unknown:uncultivated organism with predicted taxonomy: Collinsella
  REGION 1..1003: note = MG14-219 effector

SEQ ID NO: 893 - protein, 985 aa, unidentified; identical to SEQ ID NO: 805
  REGION 1..985: note = Description of Unknown:uncultivated organism with predicted taxonomy: Collinsella
  REGION 1..985: note = MG14-220 effector

SEQ ID NO: 894 - protein, 1003 aa, unidentified; identical to SEQ ID NO: 789
  REGION 1..1003: note = Description of Unknown:uncultivated organism with predicted taxonomy: Collinsella
  REGION 1..1003: note = MG14-221 effector

SEQ ID NO: 895 - protein, 1003 aa, unidentified; identical to SEQ ID NO: 778
  REGION 1..1003: note = Description of Unknown:uncultivated organism with predicted taxonomy: Collinsella
  REGION 1..1003: note = MG14-222 effector

SEQ ID NO: 896 - protein, 1053 aa, unidentified
  REGION 1..1053: note = Description of Unknown:uncultivated organism with predicted taxonomy: Collinsella sp.AM13-34
  REGION 1..1053: note = MG14-223 effector
VIRLESGMDKAKGADIGELGFDPATFATALMTLEEFRSKDRVIWAGLDIGVASTGLCLVDVRNHEIVLMASHLFKSPVVDKKKATAAPESLASVRRGARSVRRNIMREGRRKKAIRAALADFDLIPADADGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRDLFAVKKSVKPLKWSGLRRRLGLSEGDSFKGRPVEEEKRDCIALPAWAVLCAGLYEGHRDLLERLHDHIDDADAVCSALTFASSAASLAGRLAPLALSDDEVEAIIDLPYSARLFSGYANASLEALQMLRGTFEDPRVTSLRQAEEDSGLAQARAILAEERGGSADGLLCAFSDYDPTCRNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGAAIDFRRMLEEHRYAEIDHILPVSRTCDDSQANKVLCLTKSNRDKSNRSPYEWMTSGEASAPDWGEFCGRMERWAKMCEPRRYARKKLANLTCENLAERAGNFIDRNLNDTRYMSVALAKWLRECLPFTKDGHEHVFCVAGGATALMRSVWDIGITGPDGKKNRDDDRHHAVDAAVIACCTPGIVRNVALVNEGHARADVRQRLFSDSLPYPEFKEQVDAWIPCIVPTLTLPNTVTGSVLKDTVYPYLGRDEAGKDLYLTVKRDKDGRIVERKVNKATTMWKDGQGGCRAYGSMCALEAVFDASAGKRGRWSFDPVYCIDIPHREAVRRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAAGVQME

SEQ ID NO: 897 - protein, 1004 aa, unidentified; identical to SEQ ID NO: 742
  REGION 1..1004: note = Description of Unknown:uncultivated organism with predicted taxonomy: Collinsella
  REGION 1..1004: note = MG14-224 effector

SEQ ID NO: 898 - protein, 1003 aa, unidentified
  REGION 1..1003: note = Description of Unknown:uncultivated organism with predicted taxonomy: Collinsella
  REGION 1..1003: note = MG14-225 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 899 - protein, 1003 aa, unidentified; identical to SEQ ID NO: 898
  REGION 1..1003: note = Description of Unknown:uncultivated organism with predicted taxonomy: Collinsella
  REGION 1..1003: note = MG14-226 effector

SEQ ID NO: 900 - protein, 1005 aa, unidentified; identical to SEQ ID NO: 727
  REGION 1..1005: note = Description of Unknown:uncultivated organism with predicted taxonomy: Collinsella
  REGION 1..1005: note = MG14-227 effector

SEQ ID NO: 901 - protein, 1026 aa, unidentified; identical to SEQ ID NO: 794
  REGION 1..1026: note = Description of Unknown:uncultivated organism with predicted taxonomy: Olsenella
  REGION 1..1026: note = MG14-228 effector

SEQ ID NO: 902 - protein, 1005 aa, unidentified
  REGION 1..1005: note = Description of Unknown:uncultivated organism with predicted taxonomy: Olsenella
  REGION 1..1005: note = MG14-229 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRQLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDHRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 903 - protein, 1004 aa, unidentified; identical to SEQ ID NO: 774
  REGION 1..1004: note = Description of Unknown:uncultivated organism with predicted taxonomy: Collinsella
  REGION 1..1004: note = MG14-230 effector

SEQ ID NO: 904 - protein, 1004 aa, unidentified; identical to SEQ ID NO: 786
  REGION 1..1004: note = Description of Unknown:uncultivated organism with predicted taxonomy: Collinsella
  REGION 1..1004: note = MG14-231 effector

SEQ ID NO: 905 - protein, 1003 aa, unidentified; identical to SEQ ID NO: 812
  REGION 1..1003: note = Description of Unknown:uncultivated organism with predicted taxonomy: Collinsella
  REGION 1..1003: note = MG14-232 effector

SEQ ID NO: 906 - protein, 1003 aa, unidentified; identical to SEQ ID NO: 734
  REGION 1..1003: note = Description of Unknown:uncultivated organism with predicted taxonomy: Collinsella
  REGION 1..1003: note = MG14-233 effector

SEQ ID NO: 907 - protein, 1004 aa, unidentified; identical to SEQ ID NO: 815
  REGION 1..1004: note = Description of Unknown:uncultivated organism with predicted taxonomy: Collinsella
  REGION 1..1004: note = MG14-234 effector

SEQ ID NO: 908 - protein, 1002 aa, unidentified; identical to SEQ ID NO: 790
  REGION 1..1002: note = Description of Unknown:uncultivated organism with predicted taxonomy: Collinsella
  REGION 1..1002: note = MG14-235 effector

SEQ ID NO: 909 - protein, 1004 aa, unidentified; identical to SEQ ID NO: 807
  REGION 1..1004: note = Description of Unknown:uncultivated organism with predicted taxonomy: Collinsella
  REGION 1..1004: note = MG14-236 effector

SEQ ID NO: 910 - protein, 1002 aa, unidentified
  REGION 1..1002: note = Description of Unknown:uncultivated organism with predicted taxonomy: Collinsella
  REGION 1..1002: note = MG14-237 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHENGTSRALSATERDECIAILFSCEPIRDNEDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 911 - protein, 1027 aa, unidentified; identical to SEQ ID NO: 782
  REGION 1..1027: note = Description of Unknown:uncultivated organism with predicted taxonomy: Atopobium sp.ICM42b
  REGION 1..1027: note = MG14-238 effector

SEQ ID NO: 912 - protein, 1004 aa, unidentified
  REGION 1..1004: note = Description of Unknown:uncultivated organism with predicted taxonomy: Collinsella
  REGION 1..1004: note = MG14-239 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 913 - protein, 1003 aa, unidentified; identical to SEQ ID NO: 772
  REGION 1..1003: note = Description of Unknown:uncultivated organism with predicted taxonomy: Collinsella
  REGION 1..1003: note = MG14-240 effector

SEQ ID NO: 914 - protein, 1004 aa, unidentified; identical to SEQ ID NO: 795
  REGION 1..1004: note = Description of Unknown:uncultivated organism with predicted taxonomy: Collinsella
  REGION 1..1004: note = MG14-241 effector

SEQ ID NO: 915 - protein, 1003 aa, unidentified; identical to SEQ ID NO: 753
  REGION 1..1003: note = Description of Unknown:uncultivated organism with predicted taxonomy: Collinsella
  REGION 1..1003: note = MG14-242 effector

SEQ ID NO: 916 - protein, 1004 aa, unidentified; identical to SEQ ID NO: 766
  REGION 1..1004: note = Description of Unknown:uncultivated organism with predicted taxonomy: Collinsella
  REGION 1..1004: note = MG14-243 effector

SEQ ID NO: 917 - protein, 1006 aa, unidentified
  REGION 1..1006: note = Description of Unknown:uncultivated organism
  REGION 1..1006: note = MG14-244 effector
MAMRRPYLVLGLDPGIASCGFCLLDLTNHKILLMGVRLFSVPKNRSGVSLAAERRAARSTRRNNHRTKSRLKRCLSILKAAGLVPEDADRGWLQARKKDKPVIKLRAVGLVRILSDRELAQALYSLCEHRGYIPHGEGKEGAADDADGKKVLSAIKKNMEDMDKGGYRTVGEMLYTQGRSRNRGGNYDRCVYNSQIQEEVSSIFAAQRSFGNPKATAELEQEYMECLTSEKSSSGHDRRSYEAVGSCVYFPELKRAAKADISSELCRAYERFGHLVIVHKDGTEQTLTSEQISRYISALFTPSAIQKKVQRITCATIRKDLDISGASVFKGVSHEQEKKEVFDPKAWRCLSKCLAGDHGELLERMWQDRSLGDAVCEALTYSSTEESLEGQLETLDLSEDECRALKAVPFNSKIFKGYGTRSIKALSLLVGAFEDPDVRTLADAEKATGLDMKRAEDRMPRSTKLPPYSVYDPTCKNPVVLRAMGQMRKIVNAIIKEHGVPDEIHIELSRDLKMSKREKDAVAKRQRTNEAANKKRATLAAGILGCEPSEVSHLVIRKLALREEQSDKDIYTGAAIDLQRLVEDDHYCEIGHILPYSRTGMGGWNNEVLVLAASNQKKRERTPYEWMQQDAGKAGVPAWDEYSSRVTATIDNPRKRRNLLCKDTGDEAMNGFLLRDLNDTRYMSVAVKNYLEDCLLFPEDGRKLHVTAVSGGATASLRRVWGLNSNGSDDEKTNSNTMRNSIDAAVIAACSVKTVQAVAKTRSLGRETFRHMRRSRLADTQPWETFADDVIVKCKTVIPTRMAEHGVTGCALNEFVYRIDGFNEKGYAILSRQVDRATRKRGIQVAGNYMPFGESSAKLVGQIAFIRLWHDPDFGKDGRWYVEPVYYNDIPALGNGVYQPKYILSKHPRMEWLPVPEAALSGTPLTLFPGDIIVAGNHIARFKKLDIACQGLGMLNILNEQLAVKNFPTINRWKNDMNIFILQEDCLGKCFNSLDIDSGSSTFTLR

SEQ ID NO: 918 - protein, 1006 aa, unidentified
  REGION 1..1006: note = Description of Unknown:uncultivated organism with predicted taxonomy: Olsenella
  REGION 1..1006: note = MG14-245 effector
MEANRPYLVLGLDPGIASCGFCLLDMTDHKILEMGSHLFDAPQEAKTKTSLAVTRRNARSARRNTLRTATRMKHCLALLKGADLVPEDADKAWLQSKKGDKPILKLRANGLDRKLADREFAQVLYSLCGRRGYIPHGEGRLGETDDGEGRKVLSAIKANEATMKRGNYRTVGEMLYANDGKSRNRGGDYSLCVYNSQIKDEVRALFAAQRALGNSKASEGFEKDYIDCLEWEKKTVDHDKRVYELVGACPYFPEEKRAADADISSELCRAYERLGHIAIVHEDGSEQNLTPNQIDGYLDVLFSPLPLKGNKECKVTYGTIRKDLDLSGKDVFKGVAQDGEKGEPFSPKSWRCLRTALYENHEDLLVRMLKDRELGDDICEALTFASTEASLGERLGLLDLTDDEQAALCSSVPFTGKLFKGYGNRSLKALGILLGAFEEPEIRTLTDAERATGLLDLRLADRGLRDNLLPSYSKYDPTCRNPVVLRSMGRMRRIVNAIIRIHGVPDEIHIELGRDLKMSNKEKATVSKNQRANEAANKKWAAKAANILGCSPEEVPGRIVRKLAMREEQGDKDAYTGAAIDLEHLVRDDRYCEIDHILPYSRTCDDSRANKVLVLSKSNQDKRERTPYEWMTSGEPGAPDWDEYRNRVMATVKYARKRANLLNTDLGPNVQAQFLARNLNDDRYMSVAVKNYLEDCLLFPNDGRKKHVTAVAGGATGNLRWVWGLNFGQGNTKDRDDDRHHAVDAAIIAACSESTVKKVAEASSKGRETFKHLRKSRLSDTQPWPTFAEEVAARRAFVVPTRMVNHGVTGRVFEDTLYHLEGFTNDKGKYPLVRAGEKTAKKGNVRIGPDGSVKLIDGMAFLRLWLDPNARPNGKVKGKWYAEPVYYADIPAIKAGTYVPRACTIHVARNAWEPVPESAMQREPVVLFAGDVVEVDGHIGRYSGFNIFGGRITILNLLTKAEVGDWPSLGSWGRDTQVRVLQEDCLGHCYDDIVINPDNSTFRQRE

SEQ ID NO: 919 - protein, 1027 aa, unidentified
  REGION 1..1027: note = Description of Unknown:uncultivated organism with predicted taxonomy:Coriobacteriales
  REGION 1..1027: note = MG14-246 effector
MGQQNQEMANARHYLVLGLDPGIASCGFCLLDMTDHKILEMGSHLFDAPQNPKSKQNLSVERRNARSARRNLKRTRDRQKKCLELLKQCGLSPSDADKQWLQSRKGDKPVIKLRASALDRTLTDRELAQVLYSLTGRRGYIPHGEGHLDDVDDAEAGKVLAAVRENQNQMAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLLPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 920 - protein, 1027 aa, unidentified
  REGION 1..1027: note = Description of Unknown:uncultivated organism with predicted taxonomy:Coriobacteriales
  REGION 1..1027: note = MG14-247 effector
MGQQNQEMANARHYLVLGLDPGIASCGFCLLDMTDHKILEMGSHLFDAPQNPKSKQNLSVERRNARSARRNLKRTRDRQKKCLELLKQCGLSPSDADKQWLQSRKGDKPVIKLRASALDRTLTDRELAQVLYSLTGRRGYIPHGEGHLDDVDDAEAGKVLAAVRENQNQMAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLPPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 921 - protein, 858 aa, unidentified
  REGION 1..858: note = Description of Unknown:uncultivated organism
  REGION 1..858: note = MG14-248 effector
MAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLPPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 922 - protein, 1027 aa, unidentified; identical to SEQ ID NO: 920
  REGION 1..1027: note = Description of Unknown:uncultivated organism with predicted taxonomy: Olsenella
  REGION 1..1027: note = MG14-249 effector

SEQ ID NO: 923 - protein, 1007 aa, unidentified
  REGION 1..1007: note = Description of Unknown:uncultivated organism with predicted taxonomy: Olsenella
  REGION 1..1007: note = MG14-250 effector
MESERAYLVLGLDPGIASCGFCLLDMTNHKILEMGSRLFKTPQEDKTKVSLAVTRRNARSARRNNERTKSRMKHCMDILADEGLIPEDADKTWFQSKKGDKPILKLRSCGLNRALTDREFAQVLYSLCGHRGYIPHGEGKDAETDDAEGKKVLNAIKRNTEEMAAGGYRTVGEMLHSRGKSRNRGGNYDFCVYNSQIQSEVHAIFEAQRALGNLKANEKFEDRYLECLTWEKKSSDHDKKVYDQVGTCIYFPELKRAADADVSSELCRAYEKLGHLVIVHVDGAEQRLTGEQISHYIGILFSPTPLNNNKYCKVTYSTIRSDLDLSGKSVFKGVPQEKEKDEVFVPKAWRCLRKVLANDHEDLLDRMLNDRELGDAICEALTFSSSETSLQEQLEPLGLAEDECVALSSIPFNGKLFKGYGSRSIKALSILLGAFEEPGVQTLADAEKATGLDRKRLEDRVARSELLPPYNTYDETCRNPVVLRAMGQMRHIVNAIIRIYGVPDEIHIELGRELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNLNDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHGVTGCVFEDFSYSLEGIDEKGYAHISRQTDRTTGECRSLKASNFEIVNETTVKLLDSMAFLRLWHDPHAGKTGRWYIEPVYCADIPNLDGKTYHPRYQKQKVARSGWPLVPAEALKNKPLLLFRGDVLIVGNHIARYWKFDIGGGKVTMLSIVDINSEAKGFPSISKWKNDMPVRILSEDCLASCYKHMTIDSENSTFEER

SEQ ID NO: 924 - protein, 1006 aa, unidentified
  REGION 1..1006: note = Description of Unknown:uncultivated organism
  REGION 1..1006: note = MG14-251 effector
MAMQRPYLVLGLDPGIASCGFCLIDLANHKILLMGVRLFSVPKNRAGVSLAAERRAARSARRNNQRTKSRLKRCLTILKAAGLVPEDADRGWLQARKKDKPVIKLRAAGLDRVLSDRELAQVLYSLCEHRGYIPHGEGKEGATDDADGKKVLSAIKKNMEDMAKGGYRTVGEMLCAQGRSRNRGGNYDRCVYNSQIQEEARAIFAAQRSFGNLNVTAELEQEYMECLTSEKSSSDHDRRSYEVVGSCVYFPELKRAAKADISSELCRAYERFGHLVIVHKNGNEQTLTHEQINRYISALFMPSALQKKAQRITYATIRKDLDISGTSVFKGISHEQEKNEVFEPKAWRCLSKCLAENHGELLDRMWLDRALADSVCEALTYASTEVSLKGQLEALDLSEDECRAIKAIPFNSKIFKGYGTRSIKALSLLVGAFEDPDVRTLADAERATGLDMKRAEDRMPRSIMLPPYSAYDPTCRNPVVLRAMGQMRKIVNAIIKDHGVPDEIHIELSRNLKMSKREKDAIAKRQRSNEAANKKWAALAAGILDCEPSEVPHLVIRKLALREEQGDKDVYTGAAIDLERLVADDHYCEIDHILPYSRTGMSGWNNEVLVLAASNQKKRERTPYEWMQQDAGKSGVPAWDAYSSRVAATIGNPRKRRNLLCMDTGQEAMNGFLLRDLNDTRYMSVAIKNYLEDCLLFPEDGRKLHVTAVSGGATASLRRVWGLNTKGSDDEKTNSDTMRNAIDAAVIAACSVKTVQAVAKTRSLGRETFRHMRRSRLADTQPWETFADDVLAKCETVIPTRMAEHGVTGCALNEFVYRIDGFNEKGYAILSRQIDRATGERGVQVAGNYAPFGAGSAKLVGQTAFIRLWHDPDFGKGGRWYVEPVYYKDIPTLHDISYQPRYILSGRPRTEWPPVPEAALSRPPLILFSGDILVVGNHIARFKRLDINSQKLVMLNIFDERSLVKDFPTISRWKGDTNISIFSEDVLGKCFESVDIDSESSTFTLH

SEQ ID NO: 925 - protein, 1000 aa, unidentified
  REGION 1..1000: note = Description of Unknown:uncultivated organism with predicted taxonomy: Olsenellaumbonata
  REGION 1..1000: note = MG14-252 effector
MAEQYLVLGLDPGISSCGFALLDMNNHKILEMGSHLFDAPQESKTKVSLAVGRRNARSARRNNLRTKNRQKHCMKLLKEAGLVPDDATKQWFQSAKGDRPLLELRFAALERILTNREFAQILYALSARRGYIPHGEGRISKLSDMDTSGSSDAETGKVLKAIGENNKLMVQGQFRTVGEMLYHQGKSRNKGGSYEHCVLNSQIVDEVHAIFQRQRAQQNPAATQELEDKYIENLTWEKRTLDHDARVYALVKKCKYFPSEYHAARADLSSELCSAYERLKHLRIVNADGHETALAPEQVEAYIAILFSPEPLSGRKEKVTYARIRKDLDLSAHLFFKGIDPEDEKDHEPYAPRAWRAMRKVLPTELMNRFRNDRALADAVGEALTYASSEDSLIYQLDSLDLSEAEREYILGLPFSGKIFKGYGSRSLKALGMLIDAFEEPEVTTLTEAEESSGLLGLRMSDNGMRYPLLPPYSTYDSENRNPVVLRAMGRMRRIVNAIIRIYGVPDEIHIELGRDLKRSKHEKDLISKRNRENERKNKQWRAQAAEIQGIDPDEVRPKLLKKMALWEEQGGLDAYTGHKIEFDRMISDDKYCEIDHVLPYSRTCDDSRSNKVLVLAKSNQDKRERTPYEWMTQDAQKGAPSWDEYQARVIANRHISPRKRRYLLNNNLGPDQESDFLNRNLNDDRYMSRAVKSYLEDTLIFPEDGRKKHVTAVSGGATGSLRHVWGLNFGDGNTKDRSDNRHHAVDACVIAACSEATVQAVAKARKLGAEAYKHIREDRLKDTQPWPTFADEVVARREFVIPTRMVSHGVTGQAFEDTNYRFDGLTNDTKKLGILYGNGKFTKKGNYVIGGDGNAHLVDGMAFLRLWIDPTAKKGKGKWYAEPVYYADIPAIKNGTYVPRAGKATVARNAWEAIPEAAHRTKPLVLFCGDVISMDGHTARYWSFSINTLTLKTKDLITGDDYKDFPTLGKWSKDSYPKIIQEDCLGHCYKGLVPKSSEG

SEQ ID NO: 926 - protein, 1022 aa, unidentified
  REGION 1..1022: note = Description of Unknown:uncultivated organism with predicted taxonomy: Atopobium sp.ICM42b
  REGION 1..1022: note = MG14-253 effector
MSGQSNGKTILGIDAGIASVGFCLLDIDNHQILELGSRLFDQPTEPKTDQNLSVARRQARSQRRLIARRKVRKGRCLGILKSCGLVPDDVDSGWLQSRKGDKNPLILRAEGLDRRLTDRELAQVLYLLCTHRDYIPHNADKAKTGDAAKDNERGKVLSAVGANRDKLAQLGYRTVGEMFAKEVKDDGNTAHRQGSYRNRRYKDSSGKEQSDYSHTVYMVELVDEVRQIVEAQRAFGNDRLTDSFLDTYLANMTAERGSKEKDAKVYQEQVAYCTYFPQEKRAASATLSNELANAYERLSNLRVINPDGTESCLDGVQIEQFINVLFSVKAPTLNYGKIRKTLDLSSEHYFKGIDRDRESKLEPCAPKAWRALCKSLSEKTLGHKSSLLVKMAVDRGFADTVLEAFAYASDEESFTDRVAELLANKGYDQLTDAELEDALSVPFTSRVFKGYCSRSLKALGLLLGCWEESEVSSLTEAEEASGLLQRRLADSYQRAELLPPYDSYDPTCTNPVVLRALSQMRRVINSIIKIHGIPDEIHVELSRDLKNSKAARDMIAKRQRDREKEKNALRKVIAELLSCELEDVTSNQLFRYELRQEQGDVDVYTGEQIDLMRMLLDQSYTQIDHILPYSRTAIDSRSNKVLVLSGSNAAKGERTPLEWMEEDVGAPDKDQYQSRIHSMSLPAAKKEKLLRRELTDADSRGFLDRNLNDNRYLSRAVMNWLAETLAFGDMDRRHVYAVTGAGTAILRKSWALNFGPNGLKDRNYDRHHAIDAAVIAACSVSTIQAIATAHAHERRLSESRMVSTQPWPSFAIELTQRIERVVPTHQVQHKGTGTVLQATIYGLRGMTKTNKYQIVTSGKTSTSGNLHIHPDGKSAQSIGDMAFLRLWHDSKNGKWYPEPVYYYDLPRLDSDAYVSRYITRNRSRDKWHEVPSEAMNERPLVVHRNDVLVVDGHVGRYITVDIAGGTIDVRSLLSKAKDGNLALATGFPSLSRWKDAWVVNEDCLGHCYDGFIVNSDCLAVIG

SEQ ID NO: 927 - protein, 1007 aa, unidentified; identical to SEQ ID NO: 923
  REGION 1..1007: note = Description of Unknown:uncultivated organism with predicted taxonomy: Olsenella sp.KH3B4
  REGION 1..1007: note = MG14-254 effector

SEQ ID NO: 928 - protein, 1000 aa, unidentified; identical to SEQ ID NO: 925
  REGION 1..1000: note = Description of Unknown:uncultivated organism with predicted taxonomy: Olsenella
  REGION 1..1000: note = MG14-255 effector

SEQ ID NO: 929 - protein, 800 aa, unidentified
  REGION 1..800: note = Description of Unknown:uncultivated organism with predicted taxonomy: Olsenella
  REGION 1..800: note = MG14-256 effector
MPEQLHGRTVLGIDAGIASVGFCLLDLDNHQILELGSHLFDQPTEPKTKQNLSVARRQARGQRRLIARRKVRKGRCLGILKDCGLVPADIDASWLQSRKGDKNPLILRAEGLDRRLTDRELAQVLYLLCTHRGYIPHNADKSATGDAARDNELGKVLSAVGSNREKLATSGYRTVGEMFAKEVKDDGVAAHRQGSYRNRRYKDSSGKEQGDYSHTVYMVELVDEVKQLVNAQRTFGNDKLTDAFLEAYLANMTAERGCKEKDAKVYEEQVGYCTYFPQEKRAATASLSNELANAYERFSNLRIINPDGSESRLDGMQIEQFVSALFSVKAPKVTYSKVWKALGLSSQHYFKGIDNDDKSRLEPYTPKAWRALCKSLSEKTLGHKSVLLAKMAYDRDYADAVLEAFAYASDDDSFSDRVNELLANKGYDQLTDAELEEAISVPFTSRVFKGYCSRSLKALGMLLECWEEKEITSLTEAEEASGLDRLRLSDRHERTLLLQPYDVYDPTCRNPVVLRSLSQMRRVINAIIKIHGVPDEIHVELSRDLKNSKAVKDKISNQQRRREAEKATLRRTIAELLQCEPDDVTGGQLLRYELRQEQNDQDVYTGDSIDLMRMLRDQSYTQIDHILPYSRTAIDSRSNKVLVLASSNAAKGERTPLEWMEQDANGPSIDAYQSRVHALNLPSAKKEKLLRRELTEDDAKHFLDRNLNDNRYLSRSVMNWLADTLAFDNLGHRHVYAVTGAGTAILRRHWALNFGSNGLKDRNDDRHHAIDAAVIAACSVSTIQSIATAHARGYRSSESR

SEQ ID NO: 930 - protein, 1082 aa, unidentified
  REGION 1..1082: note = Description of Unknown:uncultivated organism with predicted taxonomy: Megasphaera
  REGION 1..1082: note = MG15-1 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 931 - protein, 1113 aa, unidentified
  REGION 1..1113: note = Description of Unknown:uncultivated organism with predicted taxonomy: Selenomonas sp.AE3005
  REGION 1..1113: note = MG15-3 effector
MNYILGLDIGIASVGWAAVALDANDEPYKILDLNSRIFEKAEDPQNGDSLAAPRRKARGSRRRTRRRRHRMERLRHLFAREGLLSADKIEEIFHVPDDVYRLRAEGLTRCLKDEEWARVLYHIAKHRGFKSNRKSAASDADEGKVIEAVRQNAVLLKNYKTVGEMLFRDEKFQAAKRNKGGSYNFCVSRDMLSDEIGALFEAQRKAGNQHASEKFEADYHKIFADQRNFDDGPDINSHSPYAGNQIENMIGNCSLEPSEKRAPKASYSFMRFALLQKINHLRLKKAKGEERFLNDEERAAVEELAWKTASLTYGAVRKALSLSDEWRFTDLYYRWGKTQEEIEKKKLQFTVPYHEIRKALDKREKGRIQKLTPDALDAIGYIFTVFKNDAKIAEALKSAGIGEEDAAALMAAGLTFSGFGHISVKACRKLIPNFEKGMTYDKACKEEGYEFQGKSGEKTKFLSGNLEEIREIPNPVVRRAIAQTVKVINAVIRRYGSPVGVNVELAREMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHLTDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRKVRGAAHLETVVSPRLQNEGMILKKVPLESLKLTKEKDAIENYYAPESDRLLYEALLHRLQAFEGNGKKAFAEEFHKPKADGMPGPVVKKVKVAEKSTLSVPVHQGKGLAANGGMVRIDVFFIPEGRELGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 932 - protein, 1113 aa, unidentified
  REGION 1..1113: note = Description of Unknown:uncultivated organism with predicted taxonomy: Selenomonas sp.AE3005
  REGION 1..1113: note = MG15-4 effector
MNYILGLDIGIASVGWAAVALDANDEPYKILDLNSRIFEKAEDPQNGDSLAAPRRKARGSRRRTRRRRHRMERLRHLFAREGLLSADKIEEIFHVPDDVYRLRAEGLTRCLKDEEWARVLYHIAKHRGFKSNRKSAASDADEGKVIEAVRQNAVLLKNYKTVGEMLFRDEKFQAAKRNKGGSYNFCVSRDMLSDEIGALFEAQRKAGNQHASEKFEADYHKIFADQRNFDDGPDINSHSPYAGNQIENMIGNCSLEPSEKRAPKASYSFMRFALLQKINHLRLKKAKGEERFLNDEERAAVEELAWKTASLTYGAVRKALSLSDEWRFTDLYYRWGKTQEEIEKKKLQFTVPYHEIRKALDKREKGRIQKLTPDALDAIGYIFTVFKNDAKIAEALKSAGIGEEDAAALMAAGLTFSGFGHISVKACRKLIPNFEKGMTYDKACKEEGYEFQGKSGEKTKFLSGNLEEIREIPNPVVRRAIAQTVKVINAVIRRYGSPVGVNVELAREMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHLTDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRKVRGAAHLETVVSPRLQNEGMILKKVPLESLKLTKEKDAIENYYAPESDRLLYEALLHRLQAFEGNGKKAFAEEFHKPKADGMPGPVVKKVKVAEKSTLSVPVHQGKGLAANGGMVRIDVFFIPEGREHGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 933 - protein, 1078 aa, unidentified
  REGION 1..1078: note = Description of Unknown:uncultivated organism with predicted taxonomy: Veillonellales
  REGION 1..1078: note = MG15-6 effector
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRVLTEKVSPSDWARLLIFFAKHRGFQSNRKNEKSGEDGLMLAAIGENKKILENYRSVGDMLYSDEKFKDCKRNKGGTYRFTVSRSMLKEEVQILFKKQRELGQTFAGEDLEDEYLSIFSAQRNFDEGPGANSPYAGDQIEKMIGDCTFEDGENGRPLQKRAPKASYAFMAFNLWQKINHIRVNSKGIQRSLETEEKNKIADLAWTKENITYHDLRQITGLDEETRFSEVTYPLDSTTEEAEKKVKFSWVKPYHAMRRALDKVEKNYIRKLSREEIDAIAYAFTVYKNDKKIRTALTEKGIKENVADVLITHLDGFSKFGHLSEYACYKLLPFLEKGEEYYKACDSAGLIESPARKIKDITNPVVKRAVTQTMKVIKAVQRKYGNPVEVHIELARELARSFKDRAAMDHRMKENYAKNEKIKERLSKEFHIMNPTGQDIVKWKLYEQQQGCCAYSQKPFDVDRLLHDGNYAEVDHILPYSRSFDDTYRNKVLVLEKENRDKGNRTPMEYLADKPERKEKFIAWVKTVIKDSKKREHLLRVKYGRDEEAEWKQRHLQDTQYISRFLYNYLRNTLKLAPGYTDRKRRIIPVNGAVTGYIRKRLDIRKIRENGDLHHAVDAVVIAVTTQGMIQKVTRYSQIRENPKLIDKKTGEVLTAKEFHNKDNFPEPWPRFRQELEVRVSEDPEEAIRRLRLPAYENVGEIKKPFVSRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGKGVAYNDMMVRIDIFGVNEKGKNAYYFVPVYVSDTVKKELPCRGVVKRKSYENWKIMDDKDFLFSLYHNDMIHVVSKKPLSFTAAKGSSLLPKMETKDTYVYYKGADIKGVSITVINHDNSYGIKGMGIKTLLQLEKCEVDVLGNISFVKQEKRQGFR

SEQ ID NO: 934 - protein, 861 aa, unidentified
  REGION 1..861: note = Description of Unknown:uncultivated organism with predicted taxonomy: Megasphaerastantonii
  REGION 1..861: note = MG15-7 effector
ADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLKEGGIEKADREALLERLSGFSKFGHLSLKACYKILPFLEKGEVYSRACERAGYDFSKSSLENINDIPNPVVKRSISQTLKVINAIILQYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTATTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 935 - protein, 1084 aa, unidentified
  REGION 1..1084: note = Description of Unknown:uncultivated organism with predicted taxonomy: Dialister
  REGION 1..1084: note = MG15-8 effector
MNYVLGLDVGITSCGWAVLELNPEDEPVRIVDLNSRIFDKAEAGNGDSLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGNCTFEDGKNDRPPQKRAPKASYAFMAFNLWQKINHIRVNCKGIERSLETEEKNKIAGLAWTKENITYHDLRQITGLDEETRFSGVTYPLDSTTEEAEKKVKFSWVKPYHAMRRALDKVEKNYIRKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHLQDTQYISRFLYNYLRNTLELAPGYTDRKRRIIPVNGAVTGYIRKRLDIRKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENAGEIKKPFVSRMPRRKVRGAAHKETVRSGKLREDGYTILKTDLSALKLKNGEIEGYYRPESDRLLYEALKKRLEAFGGKGKEAFKEPFYKPKADGTPGPLVKKVKIIEKSSLNVPVHKGKGIAYNDTMVRIDIFGVNEKGKNAYYFVPVYVSDTVKKELPCRAVVSKKPYEEWKVMDDKDFLFSLYPNDMIHVVAKTPLSFTVAEGADLAPTMETKDTYVYYKKAAISVGTITVITHDNSYGIKSMGIKTLLQLEKCEVDVLGNISFVKQEKRQGFR

SEQ ID NO: 936 - protein, 1081 aa, unidentified
  REGION 1..1081: note = Description of Unknown:uncultivated organism with predicted taxonomy: Dialisterinvisus
  REGION 1..1081: note = MG15-9 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 937 - protein, 1082 aa, unidentified
  REGION 1..1082: note = Description of Unknown:uncultivated organism with predicted taxonomy: Dialister
  REGION 1..1082: note = MG15-10 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQCLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 938 - protein, 1082 aa, unidentified
  REGION 1..1082: note = Description of Unknown:uncultivated organism with predicted taxonomy: Dialister
  REGION 1..1082: note = MG15-11 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKLYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 939 - protein, 1103 aa, unidentified
  REGION 1..1103: note = Description of Unknown:uncultivated organism with predicted taxonomy: Megasphaeramicronuciformis
  REGION 1..1103: note = MG15-12 effector
MDTKELKYVVGLDIGITSVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRQLKPEEWARILLYMAKHRGFKSNRKSTADETADGDMLKAIQQNKEILSKYRSVGEMFDKDEKFSDHKRNKGGSYEFTVARSMLEDEIKLLFEKQRDFGSAFAEKDAEEEYIDLFSAQRNFDEGPGGDSPYGGNQIGKMIGLCTFEGKNGEKRAPKASYAFMATNLWQKINQIRIIKKGTELHLTAEEAGKKYEKAWNKEAMTYKDIRSEISLGDEASFKGLAYKWTETDKEETESKTKFSWVKEYHTLRKVLDKVEKNRILQLSHDEIDNIAYVFSVYKNDDKIREALEETDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSSGPIVKKCKVLDKINLSVPVHGGKGAAANANGGMIRVDIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 940 - protein, 1081 aa, unidentified
  REGION 1..1081: note = Description of Unknown:uncultivated organism with predicted taxonomy: Megasphaera sp.AM44-1BH
  REGION 1..1081: note = MG15-13 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAQEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLGEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETIENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 941 - protein, 1081 aa, unidentified
  REGION 1..1081: note = Description of Unknown:uncultivated organism with predicted taxonomy: Dialister
  REGION 1..1081: note = MG15-14 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 942 - protein, 1104 aa, unidentified
  REGION 1..1104: note = Description of Unknown:uncultivated organism with predicted taxonomy: Megasphaeramicronuciformis
  REGION 1..1104: note = MG15-15 effector
MDTKELKYVVGLDIGITSVGWATLLLDSQDEPVRILDLNSRIFDKAEVPKTGASLAAPRRMARGVRRRLRRRKFRLYRVRQYILRHHILDKAGLECLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFTEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFDGKGKDAFKEPFHKPKSDGSPGPIVKKCKVLDKINLAVPVHDGKGITKNAGGSMIRVDIFKVKKSNGGHQYYSVPIYVADTVKEALPNRAVVAYKEYDEWKIVDDKDFVFSLYPNDLLFIGGKEIKLNGTGGDTLHQGIMVQDVFLYYRGLNIAVGSIGVENSDGRYAQDSLGIKQLPIIEKYEVSVLGDLVKAMYRTRETFKHKAQRAK

SEQ ID NO: 943 - protein, 840 aa, unidentified
  REGION 1..840: note = Description of Unknown:uncultivated organism with predicted taxonomy: Megasphaerastantonii
  REGION 1..840: note = MG15-16 effector
MNYVLGLDIGITSVGWAVLELDTHDEPIRIVDLNSRIFEKAEVPKTGESLAAPRRMARSARRLTRRRRFRLHRMRRYLIRNRILDARQVEELYVDSIGKTDIYELRYQALSQPVSNSDWARLLIFFAKHRGFKSNRKHISDSGDKGQMLNAITENQEILNNYHTVGEMLYKNEKFKACKRNKGGSYAFTVSRDMLADEIHALFDVQRSLGQAYASEELEEEYMELFSAQRNFDEGPGMNSPYSGNQIEKMIGCCTFEDDEKRAPKASYAFMAFNVWQKINHLRVTCEGTDRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIELADAEALLENISGFSKFGHLSVKACYKLLKPLKQGNVYTKACEIAGYDPQKSSQGNISDIPNPVVKRALSQALKVIKAIIRQYGCPPVEIHIELARELAKSAKERTELEKAMKDNQSRNEKIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRKVHGPAHMETIRSAKM

SEQ ID NO: 944 - protein, 1082 aa, unidentified
  REGION 1..1082: note = Description of Unknown:uncultivated organism with predicted taxonomy: Dialister
  REGION 1..1082: note = MG15-17 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 945 - protein, 1103 aa, unidentified
  REGION 1..1103: note = Description of Unknown:uncultivated organism with predicted taxonomy: Megasphaeramicronuciformis
  REGION 1..1103: note = MG15-18 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSASDASDDGDMLDAIRKNKEVLSKYRSVGEMFDKDEKFSDHKRNKGGSYEFTVARSMLEDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEIGLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQAMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFYKPKSDGSLGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVISGCTLELEKTMRDTILYYKGLDISPGALKIINHDGTYQQRGLGIKSLPFIEKYEVSVLGDLVKATYRPRETFNHKAQRSK

SEQ ID NO: 946 - protein, 1104 aa, unidentified
  REGION 1..1104: note = Description of Unknown:uncultivated organism with predicted taxonomy: Megasphaeramicronuciformis
  REGION 1..1104: note = MG15-19 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGDMLDAIRKNKEVLSKYRSVGEMFDKDEKFSDHKRNKGGSYEFTVARSMLVDEIKLLFERQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFRKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYFSGDEARKKQFVAWVKSDIKKPRKRENLLREKFTADAENDWKIRHLQDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIEKYEVSVLGDLVKATYRPRETFNHKAQRSK

SEQ ID NO: 947 - protein, 1082 aa, unidentified
  REGION 1..1082: note = Description of Unknown:uncultivated organism with predicted taxonomy: Dialister
  REGION 1..1082: note = MG15-20 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRNGAYNFTVSRAMLMEEIHTLFEIQRNLGQKFADEKLEEEYVILFAAQRKFDEGPGENSPYAGNQIEKMIGSCTFEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNHILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLILVDAGKEIPFKAALKGSTLDPEKKASRFLMYYKGADIATGSISGVNHDETYKARGVGIQSLREIKKCCIDVLGNISFASKEKRQTFR

SEQ ID NO: 948 - protein, 1081 aa, unidentified; identical to SEQ ID NO: 940
  REGION 1..1081: note = Description of Unknown:uncultivated organism with predicted taxonomy: Dialister
  REGION 1..1081: note = MG15-21 effector

SEQ ID NO: 949 - protein, 1082 aa, unidentified
  REGION 1..1082: note = Description of Unknown:uncultivated organism with predicted taxonomy: Dialister
  REGION 1..1082: note = MG15-22 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKSKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 950 - protein, 1082 aa, unidentified
  REGION 1..1082: note = Description of Unknown:uncultivated organism with predicted taxonomy: Dialister
  REGION 1..1082: note = MG15-23 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKIEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 951 - protein, 1081 aa, unidentified
  REGION 1..1081: note = Description of Unknown:uncultivated organism with predicted taxonomy: Dialisterinvisus
  REGION 1..1081: note = MG15-24 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADSAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGIASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 952 - protein, 1081 aa, unidentified
  REGION 1..1081: note = Description of Unknown:uncultivated organism with predicted taxonomy: Dialister
  REGION 1..1081: note = MG15-25 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGIASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 953 - protein, 1082 aa, unidentified
  REGION 1..1082: note = Description of Unknown:uncultivated organism with predicted taxonomy: Dialister
  REGION 1..1082: note = MG15-26 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 954 - protein, 1082 aa, unidentified
  REGION 1..1082: note = Description of Unknown:uncultivated organism with predicted taxonomy: Dialister
  REGION 1..1082: note = MG15-27 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRGGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRGNGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 955 - protein, 1082 aa, unidentified
  REGION 1..1082: note = Description of Unknown:uncultivated organism with predicted taxonomy: Dialister
  REGION 1..1082: note = MG15-28 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEINTLFEIQRNLGQKFADEKLEEEYVILFASQRKFDEGPGENSPYAGNQIEKMIGSCTLEGKKEKRAPKASYVFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIERYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKESIRSGRLKEEGYTISKTALIDLKLTGDKEEIKGYYNKESDRLLYEALKKQLQRYGGKAKEAFKEPFHKPKADGTPGPIVNKVKIMEKSTMLIPVNDGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 956 - protein, 784 aa, unidentified
  REGION 1..784: note = Description of Unknown:uncultivated organism with predicted taxonomy: Dialisterinvisus
  REGION 1..784: note = MG15-29 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRY

SEQ ID NO: 957 - protein, 1081 aa, unidentified; identical to SEQ ID NO: 940
  REGION 1..1081: note = Description of Unknown:uncultivated organism with predicted taxonomy: Megasphaera sp.AM44-1BH
  REGION 1..1081: note = MG15-30 effector

SEQ ID NO: 958 - protein, 1082 aa, unidentified
  REGION 1..1082: note = Description of Unknown:uncultivated organism with predicted taxonomy: Dialister
  REGION 1..1082: note = MG15-31 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGEKSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKRTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIINKVSRYSKSRELWDYEVDMETGEVLQKKNKNTKDVFPEPWLNFRYELEQKVRVRPLNIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 959 - protein, 1082 aa, unidentified; identical to SEQ ID NO: 953
  REGION 1..1082: note = Description of Unknown:uncultivated organism with predicted taxonomy: Veillonellales
  REGION 1..1082: note = MG15-32 effector

SEQ ID NO: 960 - protein, 1081 aa, unidentified
  REGION 1..1081: note = Description of Unknown:uncultivated organism with predicted taxonomy: Dialister
  REGION 1..1081: note = MG15-33 effector
MNYVLGLDVGIASVGWAVLELNEEDNPIRIEGLGARIFDKAEVPKTGASLAAPRRMSRGIRRVIRRRRFRLQRVRSYFKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALNKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 961 - protein, 1081 aa, unidentified; identical to SEQ ID NO: 951
  REGION 1..1081: note = Description of Unknown:uncultivated organism with predicted taxonomy: Megasphaera
  REGION 1..1081: note = MG15-34 effector

SEQ ID NO: 962 - protein, 1084 aa, unidentified
  REGION 1..1084: note = Description of Unknown:uncultivated organism with predicted taxonomy: Megasphaera
  REGION 1..1084: note = MG15-35 effector
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQPVSNSDWARLLIFFAKHRGFKSNRKHISGSGDEGQMLNAITENQEILKNYRTVGEMLYKNEKFKACKRNKGGSYTFTVSRAMLADEIHTLFDVQRNLGQAYASEKLKEEYMELFSAQRNFDKGPGINSPYSGNQIEKMIGSCTFEDGEKRAPKASYAFMAFNVWQKINHLRVTCEGTYRFLSQTEKETLAALAWKKENITFKDIRRELKLDDTVRFLDVNYNLDKYKEEAEKKVKFSWVKEYHAIRKALDKVKKDRISELSHEQIDTIAYAFTVYKNDEAIKRYLLEHAIELADAEALLENISGFSKFGHLSVKACYKLLEPLQQGHVYTKACEIAGYDPQKSNQENINDIPNPVVKRALSQALKVIKAIIRQYGCPPVEIHIELARELAKSAKERTELEKAMKDNQSRNEKIKTKLHELNVMQPTGLDIVKYKLYKQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRKVHGPAHMETIRSAKMQQDGYTMVKTELTNLKLKDGEIEGYYNPSSDKILYDALKRRLEQFGGDGNKAFKDPFYKPKSDGTPGPEVKKVKIMTKSSLNVAVNQGKGVADNGSMVRIDVFGVEERGKNAYYFVPIYVADTVRETLPNKAVVPNKSYNDWKFMRDEDFLFSLYPNDLIYIESLSPVSFHTVKGCTLVPKIERKEMLLYYRKAGISTASITVLNHDNTYVKESLGIKTIGKLQKCTVDILGNVHYVQKEKRLGFK

SEQ ID NO: 963 - protein, 1081 aa, unidentified; identical to SEQ ID NO: 952
  REGION 1..1081: note = Description of Unknown:uncultivated organism with predicted taxonomy: Dialister
  REGION 1..1081: note = MG15-36 effector

SEQ ID NO: 964 - protein, 1081 aa, unidentified; identical to SEQ ID NO: 952
  REGION 1..1081: note = Description of Unknown:uncultivated organism with predicted taxonomy: Dialister
  REGION 1..1081: note = MG15-37 effector

SEQ ID NO: 965 - protein, 1112 aa, unidentified
  REGION 1..1112: note = Description of Unknown:uncultivated organism with predicted taxonomy: Selenomonasbovis
  REGION 1..1112: note = MG15-38 effector
MDRRYALGLDIGIASVGWAVLAFDDADNPYRIINMGTRIFDAAEHPKDGASLAAPRREARSARRRLRRRHHRIERTRKLLIREGLLTKDALQHLFDAPPEKDVYTLRFEGLECCLDGEEWARVLLFFSKHRGFRSNRIVDDEAGDEGKVLSAIRQNEERLQGYRTVGEMLARDPKFADRKRNKAEDYQLTVSRTMLEKEICTLFDAQRQWKNPHASEDFEQEYLEIFSSQRHFDEGPGGRSPYGGDQIEKMIGRCTLEPKEKRAPKASYSFQRFSLLQNINHLRIKSQNTERSLSDEERKAVEALCWKSPSVTYYKIRQEVNLPDDVRFAGLYYDKAPEEVEKKTKFSYTVPYHEIRKVLDKWKKGGIQELDVHQLDTIGYAFTVYKNDDRIHRYLCGHGISDAIAEVLVQNLKSFQKFGHISLKACQKLIPFLEQGMVYSDACKAAGYAAPDAEPKKFLSGGMEEIREIPNPVVRRSLSQTVKIINAVIREYGSPVEVHIELAREMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNLNDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHKVRGAAHEKSLRSPRLQEDGIIVYSTPLTKLKLGKDNNSILNYYNPDSDRLLYTALLQRLQKFQGDAEKAFKEPFHKPKADGTLGPVVRKVKVTDKSNLNVSLNHGHSIAKNDSDGGMVRVDVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 966 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-39 effector

SEQ ID NO: 967 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-40 effector

SEQ ID NO: 968 - protein, 1089 aa, unidentified
  REGION 1..1089: note = Description of Unknown:uncultivated organism with predicted taxonomy: Megasphaera sp.AM44-1BH
  REGION 1..1089: note = MG15-41 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGVMLQAVKENQELLKAYRTVGDMLYSDTKFANAKRNKGESYTFTVSRRMLTDEIQTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDPFPEPWPHFRQELEARVGKQPQEAIAALHLPTYKNVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 969 - protein, 898 aa, unidentified
  REGION 1..898: note = Description of Unknown:uncultivated organism with predicted taxonomy: Veillonellales
  REGION 1..898: note = MG15-42 effector
GEEKRALFEGQPQWGQAYAAEELEKEYIEIFGAQRNFDEGPGAGSPYGGDQIEKMIGTCTFEPMEKRAPKVSYGFMAFNLWQKINHLGLIANGVAPSFTAEEKQQIADLAWSKNNLHLQHIRKELRIPEDTIFSGVNYGIRKQDTEWAKQLEEVEKKQKFNWLTPYHEMRVALDAVKKHRITELSPDQIDTIAYAFTVFKNDEKITSYLRENGIEEDDIRALLSKVKGFSKFGHLSLKACYKILPYLEEGNIYSKACELAGYDFRSSSQEQLEDIPNPVVKRAISQTLKVIKAIVRRYGNPVEVHIELARELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHLQDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRKVKGQAHEETIRSGRLKYEGYTVTKVDLKNLKLKNGEIEGYYNPDSDRLLYNALKQQLEVYDGKGDKAFAEPFHKPKADGTPGPIVKKVKIMTKSNLNVPVNGGKGVADNGSMVRIDVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 970 - protein, 1082 aa, unidentified
  REGION 1..1082: note = Description of Unknown:uncultivated organism with predicted taxonomy: Veillonellales
  REGION 1..1082: note = MG15-43 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 971 - protein, 898 aa, unidentified; identical to SEQ ID NO: 969
  REGION 1..898: note = Description of Unknown:uncultivated organism with predicted taxonomy: Veillonellales
  REGION 1..898: note = MG15-44 effector

SEQ ID NO: 972 - protein, 1112 aa, unidentified; identical to SEQ ID NO: 965
  REGION 1..1112: note = Description of Unknown:uncultivated organism with predicted taxonomy: Selenomonasbovis
  REGION 1..1112: note = MG15-45 effector

SEQ ID NO: 973 - protein, 1081 aa, unidentified
  REGION 1..1081: note = Description of Unknown:uncultivated organism with predicted taxonomy: Dialister
  REGION 1..1081: note = MG15-46 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 974 - protein, 1078 aa, unidentified
  REGION 1..1078: note = Description of Unknown:uncultivated organism with predicted taxonomy: Dialister
  REGION 1..1078: note = MG15-47 effector
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRALTEKVSPSDWARLLIFFAKHRGFQSNRKNEKSGEDGLMLAAIGENKKVLENYRSVGDMLYSDEKFRDCKRNKGGTYRFTVSRSMLKEEVQTLFKTQRELGQTFAGEDLEDEYISIFSAQRNFDEGPGANSPYAGDQIEKMIGDCTFEDGKNGRPPQKRAPKASYAFMAFNLWQKINHIRVNSKGIERSLETEEKNKIAGLAWTKENITYYDLRQITGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIRKIRENGDLHHAVDAVVIAVTTQGMIQKVTRYSQIRENPKLIDKKTGEVLTAKEFHNKDNFPEPWPRFRQELEARVSEDPEEAIRRLRLPAYENVGEIKKPFISRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGEGAAYNKIRIRIDIFGVNEKGKMAYYFVPVYVSDTVKRELPCRAVVQDKSYENWKMMDDKDFLFSLYPNDMIHVVAKRDLSFTAAEGSSLAPKMKTKDAYVYYKGADINGGTITVINHDNSYGIKSMGIKTLLQMEKCEVDILGNISVVKQEKRQGFR

SEQ ID NO: 975 - protein, 1112 aa, unidentified; identical to SEQ ID NO: 965
  REGION 1..1112: note = Description of Unknown:uncultivated organism with predicted taxonomy: Selenomonasbovis
  REGION 1..1112: note = MG15-48 effector

SEQ ID NO: 976 - protein, 1081 aa, unidentified
  REGION 1..1081: note = Description of Unknown:uncultivated organism with predicted taxonomy: Dialister
  REGION 1..1081: note = MG15-49 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 977 - protein, 1082 aa, unidentified
  REGION 1..1082: note = Description of Unknown:uncultivated organism with predicted taxonomy: Dialister
  REGION 1..1082: note = MG15-50 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRNGAYNFTVSRAMLMEEIHTLFEIQRNLGQKFADEKLEEEYVILFAAQRKFDEGPGENSPYAGNQIEKMIGSCTFEGKKEKRAPKESYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNHILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 978 - protein, 1082 aa, unidentified; identical to SEQ ID NO: 938
  REGION 1..1082: note = Description of Unknown:uncultivated organism with predicted taxonomy: Dialister
  REGION 1..1082: note = MG15-51 effector

SEQ ID NO: 979 - protein, 1081 aa, unidentified
  REGION 1..1081: note = Description of Unknown:uncultivated organism with predicted taxonomy: Veillonellales
  REGION 1..1081: note = MG15-52 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRVPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 980 - protein, 1081 aa, unidentified; identical to SEQ ID NO: 952
  REGION 1..1081: note = Description of Unknown:uncultivated organism with predicted taxonomy: Dialisterinvisus
  REGION 1..1081: note = MG15-53 effector

SEQ ID NO: 981 - protein, 1081 aa, unidentified
  REGION 1..1081: note = Description of Unknown:uncultivated organism with predicted taxonomy: Dialister
  REGION 1..1081: note = MG15-54 effector
MNYVLGLDVGIASVGWAVLELNEEDNPIRIEGLGARIFDKAEVPKTGASLAAPRRMSRGIRRVIRRRRFRLQRVRSYFKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 982 - protein, 768 aa, unidentified
  REGION 1..768: note = Description of Unknown:uncultivated organism with predicted taxonomy: Megasphaerastantonii
  REGION 1..768: note = MG15-55 effector
AGGDDGVMLKAIQQNKEVLSKYRSVGEMFDKDEKFSDHKRNKGGSYEFTVARSMLIDEIKLLFEKQRDFGSAFAEKDAEEGYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEIGLGDEASFKGLPYKWTETDKEETEGKTKFSWVKEYHTLRKVLDKVEKNRILQLSHDDIDNIAYIFSVYKNDDKIREALEETDLDSKDIDVLIEKLGTFSKFGHLSLKACYKILPYLEQGMVYSDACTAAGYDFKKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDVKKPRKRENLLREKFTADAENDWKVRHLQDTQYISRFMLNYLQNNYELTPGNTNRKRRIIPVNGAVTAYVRKRLGISKIRENGDLHHAVDATVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADG

SEQ ID NO: 983 - protein, 1112 aa, unidentified; identical to SEQ ID NO: 965
  REGION 1..1112: note = Description of Unknown:uncultivated organism with predicted taxonomy: Selenomonasbovis
  REGION 1..1112: note = MG15-56 effector

SEQ ID NO: 984 - protein, 1081 aa, unidentified; identical to SEQ ID NO: 981
  REGION 1..1081: note = Description of Unknown:uncultivated organism with predicted taxonomy: Dialister
  REGION 1..1081: note = MG15-57 effector

SEQ ID NO: 985 - protein, 1094 aa, unidentified
  REGION 1..1094: note = Description of Unknown:uncultivated organism with predicted taxonomy: Dialister
  REGION 1..1094: note = MG15-58 effector
VDIFSKYFVQRREAIYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFQAEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 986 - protein, 1081 aa, unidentified; identical to SEQ ID NO: 973
  REGION 1..1081: note = Description of Unknown:uncultivated organism with predicted taxonomy: Dialister
  REGION 1..1081: note = MG15-59 effector

SEQ ID NO: 987 - protein, 1081 aa, unidentified; identical to SEQ ID NO: 952
  REGION 1..1081: note = Description of Unknown:uncultivated organism with predicted taxonomy: Megasphaera
  REGION 1..1081: note = MG15-60 effector

SEQ ID NO: 988 - protein, 1081 aa, unidentified; identical to SEQ ID NO: 952
  REGION 1..1081: note = Description of Unknown:uncultivated organism with predicted taxonomy: Dialister
  REGION 1..1081: note = MG15-61 effector

SEQ ID NO: 989 - protein, 1103 aa, unidentified; identical to SEQ ID NO: 945
  REGION 1..1103: note = Description of Unknown:uncultivated organism with predicted taxonomy: Megasphaerastantonii
  REGION 1..1103: note = MG15-62 effector

SEQ ID NO: 990 - protein, 1081 aa, unidentified
  REGION 1..1081: note = Description of Unknown:uncultivated organism with predicted taxonomy: Dialister
  REGION 1..1081: note = MG15-63 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRLIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 991 - protein, 1081 aa, unidentified
  REGION 1..1081: note = Description of Unknown:uncultivated organism with predicted taxonomy: Megasphaera
  REGION 1..1081: note = MG15-64 effector
MNYVLGLDVGIASVGWAVLELNEEDNPIRIEGLGARIFEKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 992 - protein, 1082 aa, unidentified; identical to SEQ ID NO: 955
  REGION 1..1082: note = Description of Unknown:uncultivated organism with predicted taxonomy: Dialister
  REGION 1..1082: note = MG15-65 effector

SEQ ID NO: 993 - protein, 1103 aa, unidentified
  REGION 1..1103: note = Description of Unknown:uncultivated organism with predicted taxonomy: Megasphaeramicronuciformis
  REGION 1..1103: note = MG15-66 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTEADKEETESKVKFSLVKEYHTLRKVLDRVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRILYEALKKRLEQFGGKGKDAFKEPFHKPKSDGSPGPIVKKCKVLDKINLAVQVHGGNGATSNANGSMIRVDIFKVKEKNDKSSYYAVPIYVADTVKSELPKKAVCQKPYDEWPEMKEADFAFSLYPNDVIYIGGKELKMNAVLGCTLETTRSMQDVNLYFKGMDISTGAIQVVNHDGTYKQRSLGIKQLPLIEKCEVSVLGDLVKAQYRPRETFKHKAQRSK

SEQ ID NO: 994 - protein, 1053 aa, unidentified
  REGION 1..1053: note = Description of Unknown:uncultivated organism with predicted taxonomy: Megasphaerastantonii
  REGION 1..1053: note = MG15-67 effector
APRRMARGVRRRLRRRKFRLHRVRQYILRHHILDKAGLECLYKPKMDIDIFALRTAGLDRLLEPEEWARILLYMAKHRGFKSNRKSTAVAGGDDGIMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTHLDSKDIDVLIENLGTFSKFGHLSLKACYNILPYLEQGMVYSDACTAAGYDFRKSAQGSIADIPNPVVKRAISQTMKVLKAIKQKYGCPPVEIHIEMARELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVQVHGGKGITKNAGGSMVRVDVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 995 - protein, 1081 aa, unidentified
  REGION 1..1081: note = Description of Unknown:uncultivated organism with predicted taxonomy: Veillonellaceaebacterium DNF00626
  REGION 1..1081: note = MG15-68 effector
MNYVLGLDVGIASVGWAVLELDEKDEPIRIIDLSSRIFDKAEVPRTGASLAQARRIARGVRRRLRRRRFRLHRVRSYLIRQSILTKEELQNIYHCSHEESIYELRYKGLSEKLSATNWGRLLLFFAKHRGFRSNRKNDQSKEDGLMLKAISENEELLKKYRTVGEMIYSDEKFKEYKRNKGGNYQFTVSRSMLIDEIKMLFETQRKLGQFFAEQELEEKYLDIFSAQRNFDEGPGGNGFYSGNQIEKKIGVCTFEKGENGENPPKRAPKASYAFMAFTLWGKINHLRINSKGTRRALTQEEKEKVAKLSWEKASINFSTIRKELQLSPEDHFIDVRYTYGKTDEECEKGTKWNYCASYHTMRKALDKVYKNRIKELMSEQDEQKQLDDIAYAFTVYKSDEKIKNYLLQCQLEEKDAEALLAGVNNFSGFGHLSNKACYKILLHLKQGYEYAKACEMAGYDFKNISLEDIKDIPNPVVKRAIIQTLKVVRAVVREYGNPVEVHIELARDLGRNFKDRDLIKSNMEKNQKKNDEIKERIVNEFGIMQPKSQDIVKLKLCEQQDNVCVYSQKSFDLHRLFEKNYVEVDHIIPYSRSFDDTYANKVLVFNKENRDKGNKLPLEYLANQPERKEKFIAWVKSHIKDRKKRDNLLRESYSAEDKNGWKQRNLQDTQYISSYLYRYLMQNITLAPGYTDRKERIISLNGVVTGYVRKRWRIPKIRANGDLHHAVDAVVIACINDRLIKRVTEYSKAKELEYTPSDSGAVKTSMKDGFPEPWYCFRQELKARLSETPDEAIRNLHLATYCNVGNIKTPFVSRMLKCKVTGQANKETIGSGRLKDEEYVIEKTLLTELKLDKNNEIEGYYRPEDDKLLYEALKKQLMNHGGKGDKAFQAPFYKPKSDGTPGPLVKKVKLKVKLNSQVHVYQGKGIAQNGDMIRIDVFCVNKKGKKAYYFVPIYVADTVKKELPGKAVVSGKPYSAWKPMDDKDFIFSLYKNNLIYIEFNKPKSFVAEEGCTLSQTVDVKKAFLYYIKADRFAGTITVVNHDNTYKTRTGIKNTLLRFKKCVVDPLGRISFVEKEKRQRFQ

SEQ ID NO: 996 - protein, 1087 aa, unidentified
  REGION 1..1087: note = Description of Unknown:uncultivated organism with predicted taxonomy: Dialister
  REGION 1..1087: note = MG15-69 effector
MNYVLGLDVGITSCGWAVLELNHEDEPVRIVDLNSRIFDKAEAPKTGESLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNCKGIERSLETEEKNKIVGLAWTKENITYHDLRQITGLDEETRFSGVTYPLDSTTEEAEKKVKFSWVKPYHAMRRALDKVEKNYIQKLSREEIDAIAYAFTVYKNDRKIRTALTEKGIEDNVADVLITHLDGFSKFGHLSKYACYKLLPFLKKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGYCAYSQKLFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEETIRRLRLPSYENAGEIKKPFVSRMPRRKVRGAAHKETVRSGKLREDGCTILKTDLSALKLKNGEIEGYYRPESDRLLYEALKKRLEAFGGKGKEAFKEPFYKPKADGTPGPLVKKVKIIEKSSLNVPVHKGQGVAYNDTMVRIDIFGVNEKGKNAYYFVPVYVSDTVKKELPCRAVVAHKPYEEWKVMDDKDFLFSLYPNDMIHVVAKREIPFTAAKGSDLEPKIQIKDTFVYYVGANIATGNIAVISHDHSYEQGSMGIKTLSQLEKCEIDVLGNVSFVKQEKRQGFR

SEQ ID NO: 997 - protein, 1082 aa, unidentified; identical to SEQ ID NO: 938
  REGION 1..1082: note = Description of Unknown:uncultivated organism with predicted taxonomy: Dialister
  REGION 1..1082: note = MG15-70 effector

SEQ ID NO: 998 - protein, 1081 aa, unidentified; identical to SEQ ID NO: 973
  REGION 1..1081: note = Description of Unknown:uncultivated organism with predicted taxonomy: Dialister
  REGION 1..1081: note = MG15-71 effector

SEQ ID NO: 999 - protein, 1082 aa, unidentified; identical to SEQ ID NO: 950
  REGION 1..1082: note = Description of Unknown:uncultivated organism with predicted taxonomy: Dialister
  REGION 1..1082: note = MG15-72 effector

SEQ ID NO: 1000 - protein, 1081 aa, unidentified; identical to SEQ ID NO: 951
  REGION 1..1081: note = Description of Unknown:uncultivated organism with predicted taxonomy: Dialisterinvisus
  REGION 1..1081: note = MG15-73 effector

SEQ ID NO: 1001 - protein, 1081 aa, unidentified; identical to SEQ ID NO: 951
  REGION 1..1081: note = Description of Unknown:uncultivated organism with predicted taxonomy: Dialister
  REGION 1..1081: note = MG15-74 effector

SEQ ID NO: 1002 - protein, 1081 aa, unidentified; identical to SEQ ID NO: 951
  REGION 1..1081: note = Description of Unknown:uncultivated organism with predicted taxonomy: Dialisterinvisus
  REGION 1..1081: note = MG15-75 effector

SEQ ID NO: 1003 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-76 effector

SEQ ID NO: 1004 - protein, 1081 aa, unidentified; identical to SEQ ID NO: 981
  REGION 1..1081: note = Description of Unknown:uncultivated organism with predicted taxonomy: Dialisterinvisus
  REGION 1..1081: note = MG15-77 effector

SEQ ID NO: 1005 - protein, 1081 aa, unidentified; identical to SEQ ID NO: 951
  REGION 1..1081: note = Description of Unknown:uncultivated organism with predicted taxonomy: Dialister
  REGION 1..1081: note = MG15-78 effector

SEQ ID NO: 1006 - protein, 1003 aa, unidentified
  REGION 1..1003: note = Description of Unknown:uncultivated organism with predicted taxonomy: Megasphaerastantonii
  REGION 1..1003: note = MG15-79 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFLPVYVADTVKEELPNRAVLAHKPYEAWKIMKEEDFIFSLFAIDLIFVDAGKEI

SEQ ID NO: 1007 - protein, 1081 aa, unidentified; identical to SEQ ID NO: 940
  REGION 1..1081: note = Description of Unknown:uncultivated organism with predicted taxonomy: Megasphaera sp.AM44-1BH
  REGION 1..1081: note = MG15-80 effector

SEQ ID NO: 1008 - protein, 1082 aa, unidentified; identical to SEQ ID NO: 947
  REGION 1..1082: note = Description of Unknown:uncultivated organism with predicted taxonomy: Megasphaera
  REGION 1..1082: note = MG15-81 effector

SEQ ID NO: 1009 - protein, 1081 aa, unidentified; identical to SEQ ID NO: 940
  REGION 1..1081: note = Description of Unknown:uncultivated organism with predicted taxonomy: Megasphaera sp.AM44-1BH
  REGION 1..1081: note = MG15-82 effector

SEQ ID NO: 1010 - protein, 1081 aa, unidentified; identical to SEQ ID NO: 995
  REGION 1..1081: note = Description of Unknown:uncultivated organism with predicted taxonomy: Veillonellaceaebacterium DNF00626
  REGION 1..1081: note = MG15-83 effector

SEQ ID NO: 1011 - protein, 1081 aa, unidentified; identical to SEQ ID NO: 940
  REGION 1..1081: note = Description of Unknown:uncultivated organism with predicted taxonomy: Dialister
  REGION 1..1081: note = MG15-84 effector

SEQ ID NO: 1012 - protein, 1081 aa, unidentified; identical to SEQ ID NO: 940
  REGION 1..1081: note = Description of Unknown:uncultivated organism with predicted taxonomy: Dialister
  REGION 1..1081: note = MG15-85 effector

SEQ ID NO: 1013 - protein, 1082 aa, unidentified; identical to SEQ ID NO: 954
  REGION 1..1082: note = Description of Unknown:uncultivated organism with predicted taxonomy: Dialister
  REGION 1..1082: note = MG15-86 effector

SEQ ID NO: 1014 - protein, 1082 aa, unidentified; identical to SEQ ID NO: 958
  REGION 1..1082: note = Description of Unknown:uncultivated organism with predicted taxonomy: Dialister
  REGION 1..1082: note = MG15-87 effector

SEQ ID NO: 1015 - protein, 1081 aa, unidentified
  REGION 1..1081: note = Description of Unknown:uncultivated organism with predicted taxonomy: Megasphaera sp.AM44-1BH
  REGION 1..1081: note = MG15-88 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENRKKRNRIPMEYLADATERKNRFIHWVKSTIRNSRKRENLLRTDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 1016 - protein, 1082 aa, unidentified; identical to SEQ ID NO: 944
  REGION 1..1082: note = Description of Unknown:uncultivated organism with predicted taxonomy: Dialister
  REGION 1..1082: note = MG15-89 effector

SEQ ID NO: 1017 - protein, 1081 aa, unidentified; identical to SEQ ID NO: 941
  REGION 1..1081: note = Description of Unknown:uncultivated organism with predicted taxonomy: Dialister
  REGION 1..1081: note = MG15-90 effector

SEQ ID NO: 1018 - protein, 1094 aa, unidentified; identical to SEQ ID NO: 985
  REGION 1..1094: note = Description of Unknown:uncultivated organism with predicted taxonomy: Dialister
  REGION 1..1094: note = MG15-91 effector

SEQ ID NO: 1019 - protein, 840 aa, unidentified; identical to SEQ ID NO: 943
  REGION 1..840: note = Description of Unknown:uncultivated organism with predicted taxonomy: Firmicutes
  REGION 1..840: note = MG15-92 effector

SEQ ID NO: 1020 - protein, 1103 aa, unidentified
  REGION 1..1103: note = Description of Unknown:uncultivated organism with predicted taxonomy: Megasphaeramicronuciformis
  REGION 1..1103: note = MG15-93 effector
MDPKELKYVVGLDIGITSVGWATLLLDSQDEPVRILDLNSRIFDKAEVPKTGASLAAPRRMARGVRRRLRRRKFRLHRVRQYILRHHILAKAGLDCLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRFEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYMILPYLEQGLVYSDACTAAGYDFRKSAQGSIADIPNPVVKRAISQTMKVLKAIKQKYGCPPVEVHIEMARELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVQVHGGNGATSNANGSMIRVDIFKVQEKNGKHSYYSVPIYVADTVKAELPKKAVYRRPYDEWPEMKEADFAFSLYPNDAIYIGGKEIKMNAMPGCTLETTRSMQDVNLYFRGMDISTGAIRVVNHDGTYEQRSLGIKQLPIIEKYEVSVLGDLVKAMYSPRETFKHKAQRAK

SEQ ID NO: 1021 - protein, 1081 aa, unidentified; identical to SEQ ID NO: 979
  REGION 1..1081: note = Description of Unknown:uncultivated organism with predicted taxonomy: Dialister
  REGION 1..1081: note = MG15-94 effector

SEQ ID NO: 1022 - protein, 1081 aa, unidentified; identical to SEQ ID NO: 952
  REGION 1..1081: note = Description of Unknown:uncultivated organism with predicted taxonomy: Dialister
  REGION 1..1081: note = MG15-95 effector

SEQ ID NO: 1023 - protein, 1103 aa, unidentified
  REGION 1..1103: note = Description of Unknown:uncultivated organism with predicted taxonomy: Megasphaeramicronuciformis
  REGION 1..1103: note = MG15-96 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSTAVAGGEDGVMLKAIQQNKEVLSKYRSVGEMFDKDEKFSDHKRNKGGSYEFTVARSMLEDEIKLLFEKQRDFGSAFAEKDAEEEYIDLFSAQRNFDEGPGGDSPYGGNQIEKMIGLCTFEGKNGEKRAPKASYAFMATNLWQKINQIRIIEKGTERPLIAEEAGKIYEKAWNKEAMTYKDIRSEISLGDEASFKGLPYKWTETDKEETEGKAKFSWVKEYHTLRKVLDKVEKNRILQLSHDNIDNIAYIFSVYKNDDKIREALEETDLDSKDIDVLIEKLGTFSKFGHLSLKACYKILPYLEQGMVYSDACTAAGYDFKKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNEICAYSQKHIDAAKLFHDPNYAEVDHIIPYSRSFDDTYNNKVLVLTAENRQKGNRTPMEYLSGDEARKKQFVAWVKSDIKKPRKRENLLREKFTTDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSPGPIVKKCKVIDKINLAVQVHGGKGATANANGSMIRVDIFKVQEKNGKSYYYAVPIYVADTVKSELPKKAVYRRPYDEWPEMKEADFAFSLYPNDVVYIGGKEIKMNVMPGCTLESEKSMRDEVLYFKGLDIATGTIRVVNHDGTYKQKSLGIKQLSIIEKYEVSVLGDLVKAMYSPRETFKHKAQRAK

SEQ ID NO: 1024 - protein, 1104 aa, unidentified; identical to SEQ ID NO: 946
  REGION 1..1104: note = Description of Unknown:uncultivated organism with predicted taxonomy: Megasphaeramicronuciformis
  REGION 1..1104: note = MG15-97 effector

SEQ ID NO: 1025 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-98 effector

SEQ ID NO: 1026 - protein, 1104 aa, unidentified
  REGION 1..1104: note = Description of Unknown:uncultivated organism with predicted taxonomy: Megasphaeramicronuciformis
  REGION 1..1104: note = MG15-99 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRQLKPEEWARILLYMAKHRGFKSNRKSAAVAGGDDGVMLKAIQQNKEVLSKYRSVGEMFDKDEKFSDHKRNKDGSYEFTVARSMLEDEIKLLFEKQRDFGSVFAKKDAEEEYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEISLGDEASFKGLPYKWTETDKEETEGKAKFSWVKEYHTLRKVLDKVEKNRILQLSHDNIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVPVHDGKGITKNAGGSMVRVDVFKVKKSNGGHQYYLVPIYVSDTVKERLPNRAVMAHKEYDEWKIVDDKDFVFSLYSNDLLFIGGKEIKLNGTGGDTLHQGIMVQNVYLYYRGLNIAAGTISVEDHDSKYIQESLGVGRVPVLEKYEVSVLGDLIKAPYRPRETFKHKAQRSK

SEQ ID NO: 1027 - protein, 1103 aa, unidentified; identical to SEQ ID NO: 945
  REGION 1..1103: note = Description of Unknown:uncultivated organism with predicted taxonomy: Megasphaerastantonii
  REGION 1..1103: note = MG15-100 effector

SEQ ID NO: 1028 - protein, 1081 aa, unidentified; identical to SEQ ID NO: 952
  REGION 1..1081: note = Description of Unknown:uncultivated organism with predicted taxonomy: Dialister
  REGION 1..1081: note = MG15-101 effector

SEQ ID NO: 1029 - protein, 1082 aa, unidentified; identical to SEQ ID NO: 953
  REGION 1..1082: note = Description of Unknown:uncultivated organism with predicted taxonomy: Megasphaera
  REGION 1..1082: note = MG15-102 effector

SEQ ID NO: 1030 - protein, 1089 aa, unidentified; identical to SEQ ID NO: 968
  REGION 1..1089: note = Description of Unknown:uncultivated organism with predicted taxonomy: Megasphaera sp.AM44-1BH
  REGION 1..1089: note = MG15-103 effector

SEQ ID NO: 1031 - protein, 1082 aa, unidentified
  REGION 1..1082: note = Description of Unknown:uncultivated organism with predicted taxonomy: Dialister
  REGION 1..1082: note = MG15-104 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEINTLFEIQRNLGQKFADEKLEEEYVILFASQRKFDEGPGENSPYAGNQIEKMIGSCTLEGKKEKRAPKASYVFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIERYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKESIRSGRLKEEGYTISKTALIDLKLTGDKEEIKGYYNKESDRLLYEALKKQLQRYGGKAKEAFKEPFHKPKADGTPGPIVNKVKIMEKSTMLIPVNDGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 1032 - protein, 1075 aa, unidentified
  REGION 1..1075: note = Description of Unknown:uncultivated organism with predicted taxonomy: Megasphaeramicronuciformis
  REGION 1..1075: note = MG15-105 effector
MDTKEMKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGDMLDAIRKNKEVLSKYRSVGEMFDKDEKFSDHKRNKGGSYEFTVARSMLVDEIKLLFERQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFRKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSPGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIE

SEQ ID NO: 1033 - protein, 1082 aa, unidentified; identical to SEQ ID NO: 949
  REGION 1..1082: note = Description of Unknown:uncultivated organism with predicted taxonomy: Dialister
  REGION 1..1082: note = MG15-106 effector

SEQ ID NO: 1034 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-107 effector

SEQ ID NO: 1035 - protein, 1082 aa, unidentified; identical to SEQ ID NO: 977
  REGION 1..1082: note = Description of Unknown:uncultivated organism with predicted taxonomy: Dialister
  REGION 1..1082: note = MG15-108 effector

SEQ ID NO: 1036 - protein, 1109 aa, unidentified
  REGION 1..1109: note = Description of Unknown:uncultivated organism with predicted taxonomy: Megasphaerastantonii
  REGION 1..1109: note = MG15-109 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKMDIDIFALRTAGLDRLLEPEEWARILLYMAKHRGFKSNRKSTAVAGGDDGIMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTHLDSKDIDVLIENLGTFSKFGHLSLKACYNILPYLEQGMVYSDACTAAGYDFRKSAQGSIADIPNPVVKRAISQTMKVLKAIKQKYGCPPVEIHIEMARELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVTKCKVLDKINLAVQVHGGKGITKNAGGSMVRVDVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 1037 - protein, 1081 aa, unidentified; identical to SEQ ID NO: 990
  REGION 1..1081: note = Description of Unknown:uncultivated organism with predicted taxonomy: Dialister
  REGION 1..1081: note = MG15-110 effector

SEQ ID NO: 1038 - protein, 1082 aa, unidentified; identical to SEQ ID NO: 953
  REGION 1..1082: note = Description of Unknown:uncultivated organism with predicted taxonomy: Veillonellales
  REGION 1..1082: note = MG15-111 effector

SEQ ID NO: 1039 - protein, 1081 aa, unidentified; identical to SEQ ID NO: 952
  REGION 1..1081: note = Description of Unknown:uncultivated organism with predicted taxonomy: Dialister
  REGION 1..1081: note = MG15-112 effector

SEQ ID NO: 1040 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-113 effector

SEQ ID NO: 1041 - protein, 1087 aa, unidentified
  REGION 1..1087: note = Description of Unknown:uncultivated organism with predicted taxonomy: Veillonellales
  REGION 1..1087: note = MG15-114 effector
MNYVLGLDVGITSCGWAVLELNHEDEPVRIVDLNSRIFDKAEAPKTGESLAAPRRMARGIRRLTRRRKFRLHRVRGFLVRHHILTKEEIENLYITPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNSKGIERSLETEEKNKIAGLAWTKENITYHDLRQIAGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLLFLEKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGYCAYSQKPFDVNKLLHDRTYAEVDHILPYSRSFDDTYRNKVLVLTKENRDKGNRTPMEYLADKPERKGKFIAWVKTTIKDSKKREHLLRVKYGRDEEAEWKQRHLQDTQYISRFLYNYLKNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENVGEIKKPFVSRMPRRKVRGAAHKETVRSGKLRKDGYTILKTDLSALKLKNGEIEGYYRPESDRLLYEALKKRLEAFGGKGKEAFKEPFYKPKADGTPGPLVKKVKIIEKSSLNVPVHKGKGVAYNDTMVRIDIFGVNEKGKTAYYFVPVYVSDTVKKELPCRAVVAHKPYEEWKVMDDKDFLFFLYPNDMIHVVAKRDLSFTAAEGADLAPTMETKDTCVYYKAADISAGNIKVITHDNSYEKRGFGIKTLLQLEKCEVDVLGNISVVKKEKRQGFC

SEQ ID NO: 1042 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-115 effector

SEQ ID NO: 1043 - protein, 1081 aa, unidentified; identical to SEQ ID NO: 940
  REGION 1..1081: note = Description of Unknown:uncultivated organism with predicted taxonomy: Megasphaera sp.AM44-1BH
  REGION 1..1081: note = MG15-116 effector

SEQ ID NO: 1044 - protein, 1084 aa, unidentified; identical to SEQ ID NO: 962
  REGION 1..1084: note = Description of Unknown:uncultivated organism with predicted taxonomy: Megasphaera
  REGION 1..1084: note = MG15-117 effector

SEQ ID NO: 1045 - protein, 1081 aa, unidentified; identical to SEQ ID NO: 981
  REGION 1..1081: note = Description of Unknown:uncultivated organism with predicted taxonomy: Dialister
  REGION 1..1081: note = MG15-118 effector

SEQ ID NO: 1046 - protein, 1078 aa, unidentified; identical to SEQ ID NO: 974
  REGION 1..1078: note = Description of Unknown:uncultivated organism with predicted taxonomy: Dialister
  REGION 1..1078: note = MG15-119 effector

SEQ ID NO: 1047 - protein, 1104 aa, unidentified
  REGION 1..1104: note = Description of Unknown:uncultivated organism with predicted taxonomy: Megasphaeramicronuciformis
  REGION 1..1104: note = MG15-120 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLVFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRESAKGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLNGDEARKKQFVAWVKSDIKKPRKRENLLREKFTDDVENDWKERHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGSIVKKCKVLDKINLAVQVHGGKGITKNTGGSMVRVDVFKVKKGNGGHQYYLVPIYVADTVKEKLPNRAVVGSTSYDGWKILHDDSFVFSLYPNELVHISGKKIKLKGTGGNTKGQEINIEDAYLYYKALNISNGMITVVTHDNTYIQESLGIGRVPTLEKYEVSVLGDLVKATYRPRETFKHKAQRFK

SEQ ID NO: 1048 - protein, 1104 aa, unidentified; identical to SEQ ID NO: 942
  REGION 1..1104: note = Description of Unknown:uncultivated organism with predicted taxonomy: Megasphaeramicronuciformis
  REGION 1..1104: note = MG15-121 effector

SEQ ID NO: 1049 - protein, 1081 aa, unidentified; identical to SEQ ID NO: 952
  REGION 1..1081: note = Description of Unknown:uncultivated organism with predicted taxonomy: Dialisterinvisus
  REGION 1..1081: note = MG15-122 effector

SEQ ID NO: 1050 - protein, 1082 aa, unidentified; identical to SEQ ID NO: 970
  REGION 1..1082: note = Description of Unknown:uncultivated organism with predicted taxonomy: Megasphaera
  REGION 1..1082: note = MG15-123 effector

SEQ ID NO: 1051 - protein, 1081 aa, unidentified
  REGION 1..1081: note = Description of Unknown:uncultivated organism with predicted taxonomy: Dialister
  REGION 1..1081: note = MG15-124 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFVAQRKFDEGPGENSPYAGNQIEKMIGSCTLEGKKEKRAPKASYAFMAFNLWQKINHLKINRRGSERFLTEEERRRIADLEWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFRLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMPVPVNGGKGLASNGNMVRIDVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTINGVNHDNTYGIRIGLQQLKGIRKCRIDVLGNISFASKEKRQTFR

SEQ ID NO: 1052 - protein, 1081 aa, unidentified; identical to SEQ ID NO: 960
  REGION 1..1081: note = Description of Unknown:uncultivated organism with predicted taxonomy: Dialister
  REGION 1..1081: note = MG15-125 effector

SEQ ID NO: 1053 - protein, 1103 aa, unidentified
  REGION 1..1103: note = Description of Unknown:uncultivated organism with predicted taxonomy: Megasphaerastantonii
  REGION 1..1103: note = MG15-126 effector
MDTKELKYVVGLDIGIASVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKGAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKQRKRENLLREKFTADAENDWKARHLQDTQYISRFMLNYLQNNYELTPGNTDRKRRIIPVNGAVTAYVRKRLGISKIRENGDLHHAVDATVIAAVTQGVVNSVSKYSKRHELQYHVDEHGNCVDLVTGKLMGDAFKENHKIKGFPEPWPQFRAELEARVSENAAEAIRTLNLPTYSSDEEIKTPFVSRMVRHKTTGQAHEDTVRGKSNVADNEYVKKVALTELKLKDGEIEGYYNRPSDRLLYEALKKRLEQFGGKGKDAFKEPFYKPKSDGSPGPIVKKCKILDKINLAVQVHGGKGATANANGSMIRVDIFKAKEKNGKYSYYAVPIYVADTVKEELPNKAVCNKEYNRWPKMKEEDFAFSLYPNDVVYIGGKEIKMNAAPGCTLETTRSIQDVNLYFRGMDISTGAIRVVNHDGTYKQKSLGIKQLPLIEKYEVSVLGDLVKAIYKPRETFKHKVRRSK

SEQ ID NO: 1054 - protein, 1081 aa, unidentified; identical to SEQ ID NO: 973
  REGION 1..1081: note = Description of Unknown:uncultivated organism with predicted taxonomy: Dialister
  REGION 1..1081: note = MG15-127 effector

SEQ ID NO: 1055 - protein, 1081 aa, unidentified; identical to SEQ ID NO: 991
  REGION 1..1081: note = Description of Unknown:uncultivated organism with predicted taxonomy: Dialisterinvisus
  REGION 1..1081: note = MG15-128 effector

SEQ ID NO: 1056 - protein, 1081 aa, unidentified; identical to SEQ ID NO: 991
  REGION 1..1081: note = Description of Unknown:uncultivated organism with predicted taxonomy: Dialister
  REGION 1..1081: note = MG15-129 effector

SEQ ID NO: 1057 - protein, 1081 aa, unidentified; identical to SEQ ID NO: 940
  REGION 1..1081: note = Description of Unknown:uncultivated organism with predicted taxonomy: Dialister
  REGION 1..1081: note = MG15-130 effector

SEQ ID NO: 1058 - protein, 1081 aa, unidentified; identical to SEQ ID NO: 976
  REGION 1..1081: note = Description of Unknown:uncultivated organism with predicted taxonomy: Dialister
  REGION 1..1081: note = MG15-131 effector

SEQ ID NO: 1059 - protein, 1092 aa, unidentified
  REGION 1..1092: note = Description of Unknown:uncultivated organism with predicted taxonomy: Veillonellamagna
  REGION 1..1092: note = MG15-132 effector
MNYVLGLDVGITSVGWAVLELNSQDDPIRIVDLNSRIFEKAENPKNGESLALPRRQARSIRRLTRRRRFRLQRVRRYIVRSGILNKETLHRLYNTMEGLPDIYELRYRGLTQPLSAEEWSRLLIFFAKHRGFKSNRKNASDGDDGEMLSAVKANQELLKSYRTVGEMLYKNEKFKECKHNKGGSYAFTVSRAMLEDEIRALFEVQRQLGQAYAAEELEKEYIEIFGAQRNFDEGPGAGSPYGGDQIEKMIGTCTFEPMEKRAPKVSYGFMAFNLWQKINHLGLIANGVARSFTAEEKQQIADLAWSKNNLHLQHIRKELRIPEDTIFSGVNYGIRKQDTEWAKQLEEVEKKQKFNWLTPYHEMRVALDAVKKHRITELSPDQIDTIAYAFTVFKNDEKITSYLRENGIEEDDIRALLSKVKGFSKFGHLSLKACYKILPYLEEGNIYSKACELAGYDFRSSSQEQLEDIPNPVVKRAISQTLKVIKAIVRRYGNPVEVHIELARELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHLQDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRKVKGQAHEETIRSGRLKYEGYTVTKVDLKNLKLKNGEIEGYYNPDSDRLLYNALKQQLEVYDGKGDKAFAEPFHKPKADGTPGPIVKKVKIMTKSNLNVPVNGGKGVADNGSMVRIDVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 1060 - protein, 1082 aa, unidentified; identical to SEQ ID NO: 953
  REGION 1..1082: note = Description of Unknown:uncultivated organism with predicted taxonomy: Dialister
  REGION 1..1082: note = MG15-133 effector

SEQ ID NO: 1061 - protein, 1103 aa, unidentified; identical to SEQ ID NO: 993
  REGION 1..1103: note = Description of Unknown:uncultivated organism with predicted taxonomy: Megasphaeramicronuciformis
  REGION 1..1103: note = MG15-134 effector

SEQ ID NO: 1062 - protein, 1103 aa, unidentified; identical to SEQ ID NO: 945
  REGION 1..1103: note = Description of Unknown:uncultivated organism with predicted taxonomy: Megasphaeramicronuciformis
  REGION 1..1103: note = MG15-135 effector

SEQ ID NO: 1063 - protein, 796 aa, unidentified
  REGION 1..796: note = Description of Unknown:uncultivated organism with predicted taxonomy: Megasphaerastantonii
  REGION 1..796: note = MG15-136 effector
VAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRITPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFV

SEQ ID NO: 1064 - protein, 1089 aa, unidentified; identical to SEQ ID NO: 968
  REGION 1..1089: note = Description of Unknown:uncultivated organism with predicted taxonomy: Megasphaera sp.AM44-1BH
  REGION 1..1089: note = MG15-137 effector

SEQ ID NO: 1065 - protein, 1086 aa, unidentified
  REGION 1..1086: note = Description of Unknown:uncultivated organism with predicted taxonomy: Megasphaera
  REGION 1..1086: note = MG15-138 effector
MNYVLGLDIGITSVGWAVLELDTHDEPIRIVDLNSRIFEKAEVPKTGEALAAPRRMARSARRLTRRRRFRLHRVRRYLIRNDILDEQQVAVLYDDSAGKTDIYELRYQALSQPVSNSDWARLLIFFAKHRGFKSNRKHISDSGDEGQMLNAITENQELLKNYRTVGEMLYKNEKFKACKRNKGGSYTFTVSRAMLTDEIHTLFDVQRNLGQAYASEKLKEEYMELFSAQRNFDEGPGMNSPYSGNQIEKMIGCCTFEDGEKRAPKASYAFMAFNIWQKINHLRVTCEGTYRFLSQAEKETLAAFAWKKENITFKDIRNKLGLDDTVRFLDVNYNLDQYKTAEEAEKKAKFSWVKEYHAIRKALDKVKKDRISELSHEQIDAIAYAFTVYKNDEAIKSYLLEHAIELADAEALLENISGFSKFGHLSVKACYKLLEPLKQGHVYTKACEIAGYDPQKSSQGNISDIPNPVVKRALSQALKVIKAIIRQYGCPPVEIHIELARELAKNAKERTELEKAMKDNQSRNEEIKTKLHELNVMQPTGLDIVKYKLYEQQQGDCAYSQKKFDVDRLLHDSTYAEVDHIIPYSRSFDDTYRNKVLVLTKENRDKGNRTPMEYFQDKPERKEAFVRWVKRTISDGKKRNNLLRVNYSADAEKEWKDRHLQDTQYISRYLYNYLRQHIPLKEGYTDRKRRIIPVNGAVTAYVRKRLGISKIRENGDLHHAVDAVIIACVTQGVVNKISCYSKIKELRQFMTADGTIVDKETGEVLQTANPRKTDPFPEPWPKFRQELEARVSDNPAEAIAALGLPTYEGIVSISAPFVSRMPNRKVHGPAHMETIRSAKMQQDGYTMVKTDLTNLKLKDGEIEGYYNPSSDKILYDALKRRLEQFGGDSNKAFKDPFYKPKSDGTPGPEVKKVKIMTKSSLNVTVNQGKGIADNGSMIRIDVFGVEERGKNAYYFVPIYVADTVKETLPNKAVVPNKSYNDWKVMRDEDFLFSLYPNDLIYIESPTPISFHTVKGCPLVPKIERKEMFLYYRKAGISTASITVLNHDNTYVKESLGIKTIAKLQKCTVDVLGNIHYVQKEKRLGFK

SEQ ID NO: 1066 - protein, 1086 aa, unidentified
  REGION 1..1086: note = Description of Unknown:uncultivated organism with predicted taxonomy: Megasphaera
  REGION 1..1086: note = MG15-139 effector
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQQVSNSDWARLLIFFAKHRGFKSNRKHISDSGDEGQMLNAITENQEILNNYRTVGEMLYKNEKFKACKRNKGGSYAFTVSRDMLADEIHALFDVQRSLGQAYASEKLEEEYMELFSAQRNFDEGPGMNSPYSGNQIEKMIGCCTFEDGEKRAPKASYAFMAFNVWQKINHLRVTCEGTYRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIEPADAEALLENISGFSKFGHLSVKACYRLLEPLQQGHVYTKACEIAGYDPQKSNQENINDIPNPVVKRALSQALKVIKAIIRQYGCPPVEIHIELARELAKSAKERTELEKAMKDNQSRNEEIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGMIVDKETGEVLQTANPRKTDPFPEPWPKFRQELEARVSDNPAEAIAALGLPTYEGIVNISAPFVSRMPNRKVHGPAHMETIRSSKMQQDGYTMVKTELTNLKLKDGEIEGYYNPSSDKILYDALKRRLEQFGGDGNKAFKDPFYKPKSDGTPGPEVKKIKIMTKSSLNVTVNQGKGVADNGSMVRIDVFGVEEKGKNAYYFVPIYVADTVKETLPNRAVTRGEPYNNWKIMKDEDFLFSLYPNDLIYIESLSPVSFHTVKGCTLVSKIERKEMLLYYRKAGISTASITVLNHDNTYVKESLGIKTIGKLQKCTVDILGNVHYVQKEKRVGFK

SEQ ID NO: 1067 - protein, 1089 aa, unidentified
  REGION 1..1089: note = Description of Unknown:uncultivated organism with predicted taxonomy: Megasphaera sp.AM44-1BH
  REGION 1..1089: note = MG15-140 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGVMLQAVKENQELLKAYRTVGDMLYSDTKFANAKRNKGESYTFTVSRRMLTDEIRTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEMLTLKHVHKKDPFPEPWPHFRQELEARVGKQPQEAIAALHLPTYENVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 1068 - protein, 1081 aa, unidentified
  REGION 1..1081: note = Description of Unknown:uncultivated organism with predicted taxonomy: Dialister
  REGION 1..1081: note = MG15-141 effector
MNYVLGLDVGIASVGWAVLELNEEDNPIRIEGLGARIFEKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIISVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLRRLKGIRKCRIDVLGNISLVGKEKRKTFR

SEQ ID NO: 1069 - protein, 1089 aa, unidentified
  REGION 1..1089: note = Description of Unknown:uncultivated organism with predicted taxonomy: Megasphaera sp.AM44-1BH
  REGION 1..1089: note = MG15-142 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGAMLQAVKENQELLKAYRTVGDMLYSDTKFANAKRNKGESYTFTVSRRMLTDEIRTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDLFPEPWPHFRQELVARVGKQPQEAIAALHLPTYENVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGHVTFVGRENRQSFQLSKK

SEQ ID NO: 1070 - protein, 1103 aa, unidentified
  REGION 1..1103: note = Description of Unknown:uncultivated organism with predicted taxonomy: Megasphaeramicronuciformis
  REGION 1..1103: note = MG15-143 effector
MDTKELKYVVGLDIGITSVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRQLKPEEWARILLYMAKHRGFKSNRKSTADETADGDMLKAIQQNKEILSKYRSVGEMFDKDEKFSDHKRNKGGSYEFTVARSMLEDEIKLLFEKQRDFGSAFAEKDAEEEYIDLFSAQRNFDEGPGGDSPYGGNQIGKMIGLCTFEGKNGEKRAPKASYAFMATNLWQKINQIRIIKKGTELHLTAEEAGKIYEKAWNKEAMTYKDIRSEISLGDEASFKGLAYKWTETDKEETESKTKFSWVKEYHTLRKVLDKVEKNRILQLSHDEIDNIAYVFSVYKNDDKIREALEETDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSSGPIVKKCKVLDKINLSVPVHGGKGAAANANGGMIRVDIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 1071 - protein, 831 aa, unidentified
  REGION 1..831: note = Description of Unknown:uncultivated organism with predicted taxonomy: Megasphaerastantonii
  REGION 1..831: note = MG15-144 effector
LAKAGLDCLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGLVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIV

SEQ ID NO: 1072 - protein, 1056 aa, unidentified
  REGION 1..1056: note = Description of Unknown:uncultivated organism with predicted taxonomy: Megasphaerastantonii
  REGION 1..1056: note = MG15-145 effector
EVPKTGASLAAPRRMARGVRRRLRRRKFRLHRVRQYILRHHILDKAGLECLYKPKTDIDIFALRTAGLDRLLEPEEWARILLYMAKHRGFKSNRKSASDASDDGDMLDAIRKNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWAQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSTGPIVKKCKVLDKINLAVQVHGGKGATANANGSMIRVDIFKVQEKNGKHSYYSVPIYVADTVKAELPKKAVYRRPYDEWPEMKEADFAFSFYPNDVVYIGGKEIKMNIMPGCTLATENHVKNDFFYYKGLDIATGAMIVINHDGTYKQRGVGIKQLPLIEKYEVSVLGDLVKAPYRQRETFKRKVHGSK

SEQ ID NO: 1073 - protein, 757 aa, unidentified
  REGION 1..757: note = Description of Unknown:uncultivated organism with predicted taxonomy: Megasphaerastantonii
  REGION 1..757: note = MG15-146 effector
AEGLSRRLDDGEWVRVLYHIAKHRGFKSNRKSAASDADEGKVLDAVKENAELLKNYKTVGEMLFRDEKFRDAKRNKGGSYSFCVGRDMLADEIAALFDAQRRNGNKHASEEFEKACLKIFADQRSFDDGPDINSPSPYAGNQIEKMIGNCSLEPKEKRAPKASYSFMRFSLLQKINHLRLKDAKGEERPLDDEERAAVEALAWKSASLTYGAIRKALSLSDDLRFTDLYYRWDKKPEEIEKKKLPFAAPYHEIRKALDKLEKGRIQKLTPDALDAIGYIFTVFKNDTKIAAALKTAGVEEEDAAALMDYGLTFRGFGHISVKACRKLIPHLEKGMTYDKACKEAGYDLQKTGGEKTKLLSGNLEEIREIPNPVVRRAIAQTVKVVNAVIRRYGSPVAVNVELAREMGRSFQERRDMMKSMEDNNAANEKLKEEIKKDYGIAHPNGLDIVKYKLFKEQGERCAYSLKPMDARQVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLDDHLEFAPWLTGKNRHVMAVNGAVTDYTRKRLGIRKIREDGDLHHAVDAAVIAIVTQGNIQKLTNYSKQIERSRAFAKNPDGSYSDRETGEILKKDELIVRMSKHFPEPWPGFRRELEARVSDHPKELLESLRLPTYTPEELDALKPPFVSRMPTRKVRGAAHLETVVSPRLQKEGLIV

SEQ ID NO: 1074 - protein, 913 aa, unidentified
  REGION 1..913: note = Description of Unknown:uncultivated organism with predicted taxonomy: Selenomonasruminantium
  REGION 1..913: note = MG15-147 effector
SDDYKMTISREMLLQEIRSLFASQRNYGNPYASKDFEEAYTSIFLSQRNFDEGPGEGSPYAGNQIEKMIGKCTLEGGELRAPKASYSFMQFNLLQKLCHIRIRGKAGERALTADEIKRLESLAWSNASLNYGHFRKELCLADTERFTDVYYKTEDFVQEEKKNKIKITAAYHEIAKALKDKGKDYIATLSIDQLDAIAYAFSAYKSDSKIRDYMQAKGVLSEDVDLLLANLSGFSKFGHISIKACRKLIPYLKKGMGYIKACEAAGYKDKLVQKKKTLSGNIEEVQEIPNPVVKRAVSQTIKVINAIVRKYGSPVEIHIELAREMARSKKDRDAMTTSMEKNRAENETIKRELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDLIEKYLEMAPFNTNRKRHVVAVNGAVTAYVRKRLGIAKIREDGDLHHAVDAAVIACVTEGMINRISRYSKRREILYNNKLVDEETGEIIKGKEDFPEPWPWFRKELDARTSKNPALLLREMKLPTYTEAELENLREPYVSRMPCHKVRGAGHESKIRSPRLLKDGKTAIKTPLVELKLTNDKTKIAGYVNPESDKLLYDALYERLCKFGGKAEKAFAEPFYKPKADGGQGPLVKSVKISKLSTMNVELNKGNGIADNERRVRVDVFYVSEGKKKGYYLVPIYVADTIKPVLPKKAVKAHKAYDEWEEMKAEDFSFSLYPNDLIYIEHKTGIKFSLISKNSTLSKEINVKKGYFYYRGMDIAAGAINIENFDGVYQARGLGVKTLNCLRKGEIDILGNIRLINREYRHCFTKMKRDRYKKE

SEQ ID NO: 1075 - protein, 1098 aa, unidentified
  REGION 1..1098: note = Description of Unknown:uncultivated organism with predicted taxonomy: Selenomonas sp.AE3005
  REGION 1..1098: note = MG15-148 effector
MEQRYILGLDIGIASVGWAALALNDKDEPYRILDMNSRIFPEAEQPETGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKFGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWQGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGSPGPLVRSVKIAAKSVLQVDVNKGKGVAANDSMVRVDVFYRAEGKGKGYYLVPVYVADTVKDELPVKAVTRRKAYKDWDEMKSDEFLFSLYKDDLLLVRSAKDIELSFLGRKGESGNLLTTYKTREFLCYYQGTNRAACSITICNQDNTYAKESMGIKTLALLKKMQVDVLGQVSEAPAEKRQGFKQMKKDPHRRCGKNVSAPDD

SEQ ID NO: 1076 - protein, 1039 aa, unidentified
  REGION 1..1039: note = Description of Unknown:uncultivated organism with predicted taxonomy: Selenomonasruminantium
  REGION 1..1039: note = MG15-149 effector
MDLRYVLGLDIGIASVGWAVLALDDNDEPYKIEALNSRIFEKAENPKDGSSLAAPRREARSMRRRLRRRRHRSERVRHLLVREGVLSAEEAESLCSSAIPKNAVRGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGLEEAYATIFLSQRNFDEGPGEGSPYAGNQIEKMIGKCTLEGEELRAPKASYSFMRFNLLQKLSHIRIRGKVGERALTEEEIKRLESLAWSNASLNYGHFRKELGLADTDRFADVYYKTEDFVQEEKKNKIKITASYHEIAKALKDKGKEYITTLSIDQLDAIAYAFSAYKSDSKIRAYMQAKGVSSEDAALLLANLSGFSKFGHISIKACRKLMPYFEKGMGYIKACEAAGYKDKLVQKRKTLSGNIKEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKGKEDFPEPWPWFRKELDARTSKNPALLIRGLKLPTYAEEELENLHEPYVSRMPCHKVRGAGHKDTIRSPRLREEGRSVTKKALTELKLTKDKIRIEGYVNPESDRLLYEALYEKLCQFDGDAKKAFSAPFYKPKADGGQGPLVKKVKISEVSTLNVSVHKGKGIADSDRMLRVDVYYVSEGKKKGYYLVPIYVADTLKPVLPNKAVKAHKVYDEWEEMNVEDFVFSLYPNDLVYIEHKSGFKLKVVSKKSTLQNEMYGKTGVFYYCS

SEQ ID NO: 1077 - protein, 786 aa, unidentified
  REGION 1..786: note = Description of Unknown:uncultivated organism with predicted taxonomy: Selenomonasruminantium
  REGION 1..786: note = MG15-150 effector
WDKKPEEIEKKKLPFAAPYHEIRKALDKREKGRIQKLTPGALDAIGYIFTVFKNDTKIAAALKEAGIDEADAAALMDYGLTFQGFGHISVKACRKLIPHLETGMTYDKACKEAGYDFHGKSGEKAKLLSGNLEEIREIPNPVVRRAIAQTVKVVNAVIRRYGSPVAVNVELAREMGRTFQERREMMKSMEDNNTKNEKLKEELKDYGVAHPSGLDIVKLKLYKEQGGVCAYSLAAMPIEKVLNDYDYAEVDHILPYSRSFDDSYANKVLVLAKENRDKGNRTPMEYMEKTPGKKHDFVTWVKASVRNPKKRDNLLLEKFDEDKEAAWKERHLTDTKYIGSFVANLLRDHLDFAPWLNGRKQHVLVVNGAVTDYTRKRLGIRKIREDGDLHHAVDAAVIATVTQGNIQKLTNYSKQIERSRAFDKTANGSYADRETGEVLKKDELMVRMSKHFPEPWPGFRHELEARVSDHPKELLESLRLPTYTPEELDALKPPFVSRMPTRKVRGAAHLETVVSPRLQKEGLIVKKVSLEALKLTKEKDAIENYYAPESDRLLYEALLQRLKACDGDGKKAFAEPFHKPKADGTPGPVVKKVKIAEKSTLSVPVHHGRGLAANGGMVRVDVFFIPEGKEKGYYLVPVYTSDVVCGALPMRAVIGAKPYDEWKNMKEEQFLFSLYPNDLVYIESKRGIKGKLPDKMAKKSSLLQTRTQTEGLFYYKGTDIFTASIKVVATDGTYEFRGLGVRTLQKLEKWTVDVLGGALHPLHQEVRQGFSVMKRDPHSPKTMDDC

SEQ ID NO: 1078 - protein, 1098 aa, unidentified
  REGION 1..1098: note = Description of Unknown:uncultivated organism with predicted taxonomy: Selenomonas sp.AE3005
  REGION 1..1098: note = MG15-151 effector
MEQRYILGLDIGIASVGWAALALNDKDEPYRILDMNSRIFPEAEQPKTGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKFGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMRHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGAPGPLVRSVKIAAKSVLQVDVNKGKGVAANDSMVRVDVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMQVDVLGQISEAPAEKRQGFKQMKKDPHRRCGKNVSAPDD

SEQ ID NO: 1079 - protein, 1100 aa, unidentified
  REGION 1..1100: note = Description of Unknown:uncultivated organism with predicted taxonomy: Selenomonas sp.AE3005
  REGION 1..1100: note = MG15-152 effector
MEQRYVLGLDIGIASVGWAALALNDKDEPYRILDMNSRIFPVAEQSDGASLAAPRRQARGIRRRLRRRRHRLDRVRRLLVREGVLNKAGLTALYEKPVTDIYVIRYEGLERRLTPEEWARVLLFFVKHRGFKSNRLAETANDEDGQVKAALKANEELLVGYRTVGEMLYKDAKFQGHKRNKTADYQMTVSRNMLLEEIKQLFVAQREQNNGHATESFEEKYVEIFSSQRNFDEGPGGDSPYGGNLIEKMIGACTLERANGEKRAPKASYSFMRFNLLEKLSHIRITANGTMRSLTDEERRQLEQLAWRSPSLTYAHLRKALGLQETERFNDLYYSKDTAETEKKAKFSFTAAYHEIRKALDKVEKDYIKKLSPNELDVIGYAFSVFKNERNLRSYLLNNGITENICSTLLDNLKPFRKFGHISVKACRKLIPYLEKGMTYYDACKAAGYDILGKNSRKQKFLSGGMEEVREIPNPVVRRAISQTIKVLNALIRRYGSPVEIHVELAREMARSFQDRKDMHNKMENNRKANEQIIKELRENGLLQPNGLDIVKWKLYKEQQGVCAYSQKTFDVERLLHDGKYDGKYAEVDHILPYSRSFDDSYTNKVLVMAGENQHKGNRTPWEYMRDNEEKWTSFACWTNTAIRDFRKRQNLLRKNFCSEEKEWKERHLNDTKYISRFVYNLLRNHLEFNPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRKVRAAAHEETIRSAKHLDEGFTVVKKKLSDLKLTKDKMAIEGYFNPSSDTLLYQALLERLQKFDGKAAKAFAEPFYKPKADGTPGPLVRTVKIAAKSVLQVDVNKGKGVTDNESMVRVDIFYRAEGKRKGYYLVPVYVADTIKDELPIKAVTRGKPHKDWEEMNPDEFQFSLYKDDLLLVRSTKDIDMKFNEKNGEGALPPIFRTREVLVYYQATDRATASITVCNHDNTYGKRGMGVKTIALLKKMQVDVLGQVSEFPPMKRQGFKQMKKDPHRRCDRNVSASND

SEQ ID NO: 1080 - protein, 999 aa, unidentified
  REGION 1..999: note = Description of Unknown:uncultivated organism with predicted taxonomy: Selenomonas sp.AE3005
  REGION 1..999: note = MG15-153 effector
VTDIYAIRYEGLERRLTTEEWARVLLFFVKHRGFKSNRLAETANDEDGQVKDAIKANAELLVGYRTVGEMLYKDAKFQGHKRNKTADYQMTVSRNMLLEEIKQLFVAQREQNNGHATESFEEKYLEIFSSQRNFDEGPGGNSPYGGNLIEKMIGVCTLERANGEKRAPKASYSFMRFSLLEKLSHIRLTANGTTRSLTDEERSRLEQLAWQSPSLTYAHLRKALGLQETERFNDLYYSKDTAETEKKAKFSFTAAYHEIRKALDKLEKDYIKKLSPNELDVIGYAFSVFKNERNLRSYLLNNGITENVCSTLLDNLKPFRKFGHISVKACRKLIPYLETGMTYYDACKAAGYDVLGKNGCKEKFLSGGMEEVREIPNPVVRRAISQTIKVLNALIRRYGSPVEIHVELAREMARSFQDRRDMHNKMENNRKANEQIIKELRENGLLQPNGLDIVKWKLYKEQQGICAYSQKTFDVERLLHDGKYAEVDHILPYSRSFDDSYTNKVLVMAGENQHKGNRTPWEYMRDNEEKWTSFACWTNTAIRDFRKRQNLLRKNFCSEEKEWKERHLNDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALNPIFVSRMPRRKVRAAAHEETIRSAKHLDEGFTVVKKKLSDLKLTKDKMAIEGYFNPSSDTLLYQALLERLQKFDGKAAKAFAEPFYKPKADGTPGPLVRTVKIAAKSVLQVDVNKGKGVTDNESMVRVDVFYRSEGKGKGYYLVPIYVADTVKDELPLKAVTPRKCYMDWETMKPEEFLFSLYKDDLLLVCSSKDIDMKLNEKNGEGVLPPIFRTREVLVYYQATDRATASITVCNHDNTYGKRGMGVKTIALLKKMHVDVLGQVSEFPPMKRQGFKQMKKDPHRRCDRNVSASND

SEQ ID NO: 1081 - protein, 963 aa, unidentified
  REGION 1..963: note = Description of Unknown:uncultivated organism with predicted taxonomy: Selenomonasruminantium
  REGION 1..963: note = MG15-154 effector
KDGSSLAAPRREARSMRRRLRRRRHRSERVRHLLVREGVLSAEGAESLCSSAIPKNAMLGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGVEEAYTTIFLSQRNFDEGPGEGSPYAGNQIEKMIGKCTLEGEELRAPKASYSFMRFNLLQKLSHIRIRGKVGERALTEEEIKRLESLAWSNASLNYGHFRKELGLADTDRFADVYYKTEDFVQEEKKNKIKITAAYHEIAKALKDKGKEYITTLSIDQLDAIAYAFSAYKSDSKIRAYMQAKGVSSEDAALLLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLIRELKLPTYAEEELENLHEPYVSRMPCHKVRGAGHKDTIRSPRLRKEGRSVTKKPLTELKLTKDKTKIEGYVNPESDRLLYEALYEKLCQFDGDAKKAFSAPFYKPKADGGQGPLVKKVRISEVSTLNVAVHKGKGIADSDRMLRVDVYYVSEGKKKGYYLVPIYVADTLKPVLPNKAVKAHKACDEWEEMKAEDFSFSLYPNDLIYIEH

SEQ ID NO: 1082 - protein, 910 aa, unidentified
  REGION 1..910: note = Description of Unknown:uncultivated organism with predicted taxonomy: Selenomonas sp.AE3005
  REGION 1..910: note = MG15-155 effector
KANEELLTGYRTVGEMLYKDAKFQGHKRNKTADYQMTVSRNMLLEEIKQLFVAQREQNNGHATESFEEKYLEIFSAQRNFDEGPGGNSPYGGNLIERMIGTCTLERASGEKRAPKASYSFMRFSLLEKLSHIKIKTNGTTRSLTSEERRQLEQLAWQSPSLTYAHLRKALGLQDTERFNDLYYTKDIAGTEKKTKFGFTVAYHEIRKALDKMEKAYIKKLSPEDLDVIGYAFSVFKNEGNLSAYLLNHGITKDVCSILLANLKPFRKFGHISVKACRKLIPYLEQGMTYYDACIAAGYDVAGKNSRKQKFLSGGMEEVREIPNPVVRRAISQTIKVLNALIRRYGSPVEIHVELAREMARSFQDRKDMHNKMENNRKANEQIIKELRENGLLQPNGLDIVKWKLYKEQQGVCAYSQKTFDVERLLHDGKYAEVDHILPYSRSFDDSYTNKVLVMAGENQHKGNRTPWEYMSNNEEKWTAFACWTNTAIRDFRKRQNLLRKKFCSEEKEWKERHLNDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRKVRASAHEDTIRSAKYLDEGFTIVKKKLSDLKLTKDKMAIEGYFNPSSDTLLYQALLKRLQEFDGKAAKAFADPFYKPRADGTPGPLVRTVKIKTKSVLQVDVNKGKGVTDNKSMVRVDIFYRAEGKRKGYYLVPVYVADTIKDELPIKAVTKGKAYKDWDEMKPDEFLFSLYKDDLLLVRSVKDIELSFLGKKGELGNFLPTYKTREFLCYYQGTNRGACSITICNQDNTYAKESMGIKTLALLKKMQVD

SEQ ID NO: 1083 - protein, 1111 aa, unidentified
  REGION 1..1111: note = Description of Unknown:uncultivated organism with predicted taxonomy: Selenomonas sp.AE3005
  REGION 1..1111: note = MG15-156 effector
YLFINEIEMGRKVMEQRYILGLDIGIASVGWAALALNDKDEPYRILDMNSRIFPEAEQPKTGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKIGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKQNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGSPGPLVRSVKIAAKSVLQVDVNKGKGVAANDSMVRVDVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMKVDVLGQVSEAPAEKRQGFKQMKKDPHRGCGKNVSAPDD

SEQ ID NO: 1084 - protein, 861 aa, unidentified
  REGION 1..861: note = Description of Unknown:uncultivated organism with predicted taxonomy: Megasphaerastantonii
  REGION 1..861: note = MG15-157 effector
EQPKTGASLAAPRREARGSRRRTRRRRHRMERLRHLFVREGLMTADTLAALFEAPADVYQLRAEGLSRRLDAGEWARVLYHIAKHRGFKSNRKSAASDADEGKVLDAVKENAELLKNYKTVGEMLFRDEKFRDAKRNKGGSYSFCVGRDMLADEIAALFDAQRRNGNQHASEEFEKACLKIFADQRSFDDGPDINSPSPYAGNQIEKMIGSCSLEPKEKRAPKASYSFMRFSLLQKINHLRLKDAKGEERPLDDEERAAVEALAWKSASLTYGAIRKALSLSDDLRFTDLYYRWDKKPEEIEKKKLPFAAPYHEIRKALDKREKGRIQKLTPDALDAIGYIFTVFKNDTKIAAALKTAGVEEEDAAALMDYGLTFRGFGHISVKACRKLIPYLEKGMTYDKACKEAGYDLQKTGGEKTKLLSGNLEEIREIPNPVVRRAIAQTVKVVNAVIRRYGSPVAINVELAREMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLEDHLEFAPWLTGRKRHVMAVNGAVTDYTRKRLGIRKIREDGDLHHAVDAAVIAIVTQGNIQKLTNYSKRIEHAFIKNRDGSYTHPDTGEILKKDELMAQMSRHFPEPWPGFRRELEARVSDHPKELLESLRLPTYTPEEIDALKPPFVSRMPTRKVRGAAHLETVVSPRLQKEGLIVKKVSLDALKLTKEKDAIENYYAPESDRLFYEALLQRLQACDGNGK

SEQ ID NO: 1085 - protein, 764 aa, unidentified
  REGION 1..764: note = Description of Unknown:uncultivated organism with predicted taxonomy: Selenomonasruminantium
  REGION 1..764: note = MG15-158 effector
YYKTEDFVQEEKKNKIKITAAYHEIAKALKDKGKEYITTLSIDQLDAIAYAFSAYKSDSKIRAYMQAKGVSSEDAAILLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTTRKRNVVAVNGAVTAYVRKRLGIAKIRENGDLHHAVDAAVIACVTEGMINRISRYSKRREILYNNKLVDEETGEIIKGKEDFPEPWPWFRKELDARTGKNPALLIRDLKLPTYTEAELENLHEPYVSRMPCHKVRGAGHEAKIRSPRLLKDGKTAIKTPLVKLNLTNDKTKIAGYVNPESDKLLYDALYERLCKFGGKAEKAFAEPFYKPKADGGQGPLVKSVKISKSSTMNVELNKGNGIADNERRVRVDVFYVSEGKKKGYYLVPIYVADTIKPVLPNKAVKAHKACDEWEEMKAEDFSFSLYPNDLIYIEHKTGIKFSLISKNSTLSKEINIKKGYFYYRGMDIAAGAINIENVDGVYQARGLGVKTLNCLRKGEIDILGNIRLINREYRHCFTKMKRDRYKKE

SEQ ID NO: 1086 - protein, 1102 aa, unidentified
  REGION 1..1102: note = Description of Unknown:uncultivated organism with predicted taxonomy: Selenomonasruminantium
  REGION 1..1102: note = MG15-159 effector
MDLRYVLGLDIGIASVGWAVLALDDNDEPYKIEALNSRIFEKAENPKDGSSLAAPRREARSMRRRLRRRRHRSERVRHLLVREGVLSAEGAESLCSSAIPKNAMLGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGLEEAYATIFLSQRNFDEGPGEGSPYAGNQIEKMIGKCTLEEEELRAPKASYSFMRFNLLQKLSHIRIRGKVGERALTEEEIKRLESLAWSNASLNYGHFRKELGLADMDRFADVYYKTEDFVQEEKKNKIKITAAYHEIAKALKDKGKEYITTLSIDQLDAIAYAFSAYKSDSKIRAYMQAKGVSSEDAALLLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLTRELKLPTYAEEELENLHEPYVSRMPCHKVRGAGHKDTIRSPRLRKEGRSVTKKPLTELKLTKDKTKIEGYVNPESDRLIYEALYEKLCQFDGDAKKAFSAPFYKPKADGGQGPLVKKVKISEVSTLNVSVHKGKGIADSDRMLRVDVYYVSEGKKKGYYLVPIYVADTLKPVLPNKAVKAHKVYDEWEEMNVEDFVFSLYPNDLVYIEHKSGFKLKVVSKKSTLQNETYGKTGVFYYCSMNISTGALNLENLDGTYQVESLGVKTLICLRKGEIDTLGNIRLLENEVRKGFSYMKKDRYRKV

SEQ ID NO: 1087 - protein, 911 aa, unidentified
  REGION 1..911: note = Description of Unknown:uncultivated organism with predicted taxonomy: Megasphaerastantonii
  REGION 1..911: note = MG15-160 effector
RRRTRRRRHRMERLRHLFVREGLMTADALAALFEAPADVYQLRAEGLSRRLDEGEWARVLYHIAKHRGFKSNRKSAASDADEGKVLDAVKENAELLKNYKTVGEMLFRDEKFRDAKRNKGGSYSFCVGRDMLADEIAALFDAQRRNGNKHASEEFEKACLKIFADQRSFDDGPDINSPSPYAGNQIEKMIGSCSLEPKEKRAPKAGYSFMRFSLLQKINHLRLKDAKGEERPLDDEECAAVEALAWKSASLTYGAIRKALSLSDDLRFTDLYYRWDKKPEEIEKKKLPFAAPYHEIRKALDKREKGRIQKLTPDALDAIGYIFTVFKNDTKIAAALKTAGVEEEDAAALMDYGLTFRGFGHISVKACRKLIPHLEKGMTYDKACKEAGYDLQKTGGEKTKLLSGNLEEIREIPNPVVRRAIAQTVKVVNAVIRRYGSPVAINMELAREMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLEDHLEFAPWLTGKKRHVMAVNGAVTDYTRKRLGIRKIREDGDLHHAVDAAVIAIVTQGNIQKLTNYSKRIEHAFIKNRDGSYTHPDTGEILKKGELMAQMSRHFPEPWPGFRRELEARVSDHPKALLESLRLPTYTPEELDALKPPFVSRMPTRKVRGAAHLETVVSPRLQKEGLIVKKVSLDALKLTKEKDAIENYYAPESDRLLYEALLRRLKEFDGDGKKAFAEPFHKPKADGTPGPVVKKVKIAEKSTLSVPVHHGRGLAANGGMVRVDLFFIPEGKERGYYLVPVY

SEQ ID NO: 1088 - protein, 1112 aa, unidentified
  REGION 1..1112: note = Description of Unknown:uncultivated organism with predicted taxonomy: Selenomonas sp.AE3005
  REGION 1..1112: note = MG15-161 effector
MDRRYALGLDIGIASVGWAVLALDDADNPYRIINMGTRIFDAAEHPKDGASLAAPRREARSARRRLRRRHHRIERTRKLLIREGLLTKDALQHLFDAPPEKDVYTLRFEGLECCLDGEEWARVLLFFSKHRGFRSNRIVDDEAGDEGKVLSAIRQNEERLQGYRTVGEMLARDPKFADRKRNKAEDYQLTVSRTMLEKEICTLFDAQRQWKNPHASEDFEQEYLEIFSSQRHFDEGPGGRSPYGGDQIEKMIGRCTLEPKEKRAPKASYSFQRFSLLQNINHLRIKSQNTERSLSDEERKAVEALCWKSPSVTYYKIRQEVNLPDDARFAGLYYDKAPEEVEKKTKFSYTVPYHEIRKVLDKWKKGGIQELDVHQLDTIGYAFTVYKNDDRIHRYLCGHGISDAIAEVLVQNLKSFQKFGHISLKACQKLIPFLEQGMVYSDACKAAGYAAPDAEPKKFLSGGMEEIREIPNPVVRRSLSQTVKIINAVIREYGSPVEVHIELAREMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNLNDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHKVRGAAHEKSLRSPRLQEDGIIVYSTPLTKLKLGKDNNSILNYYNPDSDRLLYTALLQRLQKFQGDAEKAFKEPFHKPKADGTLGPVVRKVKVTDKSNLNVSLNHGHSIAKNDSDGGMVRVDVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 1089 - protein, 1082 aa, unidentified
  REGION 1..1082: note = Description of Unknown:uncultivated organism with predicted taxonomy: Megasphaera
  REGION 1..1082: note = MG15-162 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 1090 - protein, 767 aa, unidentified
  REGION 1..767: note = Description of Unknown:uncultivated organism with predicted taxonomy: Megasphaerastantonii
  REGION 1..767: note = MG15-163 effector
LREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAMILRYGNPVEVHIELARELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIWNSRKRENLLRIDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVKHDETYKARGIGIQSLRKNKKCCIDVLGNISFASKEKRQTFR

SEQ ID NO: 1091 - protein, 1038 aa, unidentified
  REGION 1..1038: note = Description of Unknown:uncultivated organism with predicted taxonomy: Megasphaera
  REGION 1..1038: note = MG15-164 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGFRYDLKKGKAENLEEPVSEAEKMSFSWVKDYHSIRKALDKVEKNRILKLSHEQLDTIATAFSVYKNEETIEKYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYGGKAKEAFKEPFHKPKADGTPGPIVNKVKIMEKSTMPVPVNGGKGLASNGNMVRIDVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTIN

SEQ ID NO: 1092 - protein, 846 aa, unidentified
  REGION 1..846: note = Description of Unknown:uncultivated organism with predicted taxonomy: Megasphaerastantonii
  REGION 1..846: note = MG15-165 effector
ENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 1093 - protein, 1227 aa, unidentified
  REGION 1..1227: note = Description of Unknown:uncultivated organism with predicted taxonomy: Bacteroidales
  REGION 1..1227: note = MG16-2 effector
MKRILGLDLGTNSIGWALVEVDEDGKIIKILGIGSRIIPLSPDDANEFTTGKSITKNRKRTEQRTTRKCFDRYQLRRLLLTIELRKFNMLPDERLIKLPVLDLWQLRAKAATKGNRLTLPELGRVLYHLNQKRGYKHAKSDESNDKNQREYVANVNTRYANIKQLGKTIGQFFAEKLEENQVITEKGKFYTYRIKDQVFPRKAYEEEFDQIMECQREFYPEILTDKFIDKVRNEIIYYQRKLKSCKHLVSLCEFEKRAYVNKDGKVVYDGPKVAPRTSPLFQVCKIWESVNNLKIKNRKNDELYITQEQRIAMFNFLNNNEKMTLSDMYKILKIDKSDGWWGGKAIGNGLQGNTTKMQLKKALSNCQNVDELLQFNLDIVDSDKIDEETGEVLKVVSPNCEQEPLYKLWHTIYSIQDKNELKNVLQKKWGITDETTLNSLFALDFVRPGYGNKSSKFIRKILPYLQDGLMYNEACAYIGVNHSNSLTKAENDARELLEKLPQIKKNELRQPVVEKILNQMINVVNAIFDKYGNNNGIDEIRVELARELKQSREERELTDKNNRNRQKENDSNAKLIEEYGIRASRNRIQKYRMWKESRQTCFYCGQVVDVKDFLRGYDVEVEHIIPKALFFDDSFSNKVCSCRKCNSEKGERTAYDYMSSKGEDELNRYIRTVEDRCKKGEISKTKRERLLTPADKIPTDFINRQLRETQYIAKKSVEILKQICRNVWTTSGSVTDFLRHNWGYDEILHTLDFDRYKSGGLTEVIEIEHKGQKHRIERIKDWSKRLDHRHHAVDALVVACTKQSYIQRLNNLNTERDAMYQDIEAQSVEWKEKHSLLEKWIKLQPHPTVSEVTDKVDEILVSFKAGKRVATLGKRSVYKNGKKTVVQNNIIVPRGALCEESVYGQINLIEKNKPIKYLFENPSLIFKPYIKALVEERLKEYNGDTSKAISSLKNNPIYLRKDKSVVLEYGTCYKKEYVKKYSLNSIKAKDVDSIIDKHIREVVRQRLEDNNNNEKAAFASPLYADKQKQIPIKSVRCTTGINIAAPVNYNESNDPISFVKPGNNHHIAIYKDKDGKRQEHIVTFWHAVERKKYGMPVVITNPKEIWDLIIEKSLDLPESFLNCLPNSDWNYEISMQQNEMFVMGMSEDEFQDAIRNNDYKTLNKYLYRVQSVSESDYWLRLHIETMNDKTPEGNIIKKYYRIKSINTFFNFNPHKVKITLLGEIQSS

SEQ ID NO: 1094 - protein, 1165 aa, unidentified
  REGION 1..1165: note = Description of Unknown:uncultivated organism with predicted taxonomy: Bacteroidales
  REGION 1..1165: note = MG16-5 effector
MATKKILGLDLGTNSIGWALIETEDSNPKSILAMGSRIVPLSTDDSTQFAKGQAITKNADRTQKRTARKGLNRYQMRRAMLTEELRRHGMLPERTDENIMDLWRLRSDAATDGKQLSLPQIGRVLYHINQKRGYKHSKADNSANTKQTKYVEAVNQRYRDIQACHQTIGQYFYEQLLSSAVQTPSGSYYTYRIKDKVLPREAYIAEFDQIMKVQRVFYPDVLTDELVDTLRNHIIFYQRPLKSCKHLVSLCEFEKRPFKREDGQIVYSGPKCAPRTSPLAQFCTVWEAVNNITLTNRQNETFEITQEQRVAMADFLNQHDKMGVKDLQKILGISPKDGWWAGKAIGKGLKGNTTFTQLREALGNLPNAEHLLKMKLSMVDAAVDTTTGELIRQVSPQVEEEPLFRLWHLVYSLQNEDELRKALRKQFGIDDEEVLDKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYENRIREYGIQPSRSRIQKYKMWEESNHLCFYCGKPVNVTDFLAGAEVEIEHIIPQSVLFDDSYSNKVCACRACNQAKGNLTAREFMEKHSKEEYDSYLRRVDDAFNAHRISKTKRDHLLWRKEDIPQDFIDRQLLQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKRAATPAKRAVYQNGKRHIVQTGLQVPRGALSEETVYGKLGNKYVVKYPLGHQSMKMDDIVDPTIREIVRTRLNAFGGKAKDAFAEPLYSDAAHQMQIKTVRCYTGLQDKAVVPVRFNAQGEPVGFVKMGNNHHIAIYRDAKGQYQESVVSFWQAVERKRYGIPVVIEQPHEVWDKLINSDNIPQDFLETLPHDDWQFVVSLQQNEMFILGMDDADFEAAMEQKDYRTLNKYLYRVQKISSKEYCFRYHTETSVDDKYDGVINKSISMELQKLKRLTSISAFFSQHPHKVRVNLLGEVSAL

SEQ ID NO: 1095 - protein, 1165 aa, unidentified; identical to SEQ ID NO: 1094
  REGION 1..1165: note = Description of Unknown:uncultivated organism with predicted taxonomy: Bacteroidetes
  REGION 1..1165: note = MG16-6 effector

SEQ ID NO: 1096 - protein, 1224 aa, unidentified
  REGION 1..1224: note = Description of Unknown:uncultivated organism with predicted taxonomy: Bacteroides
  REGION 1..1224: note = MG16-7 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEELDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1097 - protein, 1224 aa, unidentified
  REGION 1..1224: note = Description of Unknown:uncultivated organism with predicted taxonomy: Bacteroides
  REGION 1..1224: note = MG16-8 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKDHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1098 - protein, 1224 aa, unidentified; identical to SEQ ID NO: 1096
  REGION 1..1224: note = Description of Unknown:uncultivated organism with predicted taxonomy: Bacteroides sp.CAG:770
  REGION 1..1224: note = MG16-9 effector

SEQ ID NO: 1099 - protein, 1224 aa, unidentified
  REGION 1..1224: note = Description of Unknown:uncultivated organism with predicted taxonomy: Bacteroides
  REGION 1..1224: note = MG16-10 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1100 - protein, 1224 aa, unidentified; identical to SEQ ID NO: 1099
  REGION 1..1224: note = Description of Unknown:uncultivated organism with predicted taxonomy: Bacteroides
  REGION 1..1224: note = MG16-11 effector

SEQ ID NO: 1101 - protein, 1165 aa, unidentified; identical to SEQ ID NO: 1094
  REGION 1..1165: note = Description of Unknown:uncultivated organism with predicted taxonomy: Bacteroidetes
  REGION 1..1165: note = MG16-12 effector

SEQ ID NO: 1102 - protein, 1224 aa, unidentified; identical to SEQ ID NO: 1096
  REGION 1..1224: note = Description of Unknown:uncultivated organism with predicted taxonomy: Bacteroides
  REGION 1..1224: note = MG16-13 effector

SEQ ID NO: 1103 - protein, 1224 aa, unidentified
  REGION 1..1224: note = Description of Unknown:uncultivated organism with predicted taxonomy: Bacteroides sp.CAG:770
  REGION 1..1224: note = MG16-14 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKNYYFRYQYETQLDDKEAALSMKKFYRVTSLSSLQSLNPKKVSINLLGDISLHNII

SEQ ID NO: 1104 - protein, 1221 aa, unidentified
  REGION 1..1221: note = Description of Unknown:uncultivated organism with predicted taxonomy: Bacteroides sp.CAG:770
  REGION 1..1221: note = MG16-15 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFHQRDLKSCKHLVSQCEFMTRSFLDADHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPTDKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRILAQEGLLIPRGALCEESVYGRIHSLEKEVPVKKLFERVDDIVKPGIRAAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMCVLGMEDDEFRDAMEVKDYKTLGAHLYRVQKLASIYYVFRHQYETQLDDSKGAQIMKKFYRAQSFKALFALHPRKVSVSLLGEMALKDD

SEQ ID NO: 1105 - protein, 1221 aa, unidentified
  REGION 1..1221: note = Description of Unknown:uncultivated organism with predicted taxonomy: Bacteroides sp.CAG:709
  REGION 1..1221: note = MG16-16 effector
MKKILGLDLGVGSIGWSLINADKDNKPIAILGLGSRIISLSPDESSEFTSGNAASKNQKRTQKRTARKGYDRYQMRRQALTDKLRELKMLPDEHLIKLPVLDLWTLRARAATPGERLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINELRNEIIFYQRNLKSCKHLVSRCEFMTRSFLDEEHRPVLDASGKLVISGPKVAPKSSPIFQVCKIWEEINNLSIRNKENDELHISPEQKKDIFEYLDNNEKITSAALYKILGIGKGDGWSVDKALSKGFTGNTTKVAISKALGKANDAKKRDLLRFDLRLKENGVNKDTGEIVCEIDPECENEPLYKLWHVIYSINDKDAQRHALTNQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKKVTTPGKRYVYRGGKRILAQEGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAESLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVTSLQQNEMFVLGMEDDEFRDAMAEADYKALGAHLYRVQKLAGSDYYFRSHYETLLDDSAGARIMKKFYRVRSFNALFNLHPRKVAVSLLGEMSLKND

SEQ ID NO: 1106 - protein, 1221 aa, unidentified
  REGION 1..1221: note = Description of Unknown:uncultivated organism with predicted taxonomy: Bacteroides sp.CAG:770
  REGION 1..1221: note = MG16-17 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKVLGKDHNTKKSDLLRFDLRLKENGVNKDTGEIIYEIDPTCENEPLYRLWHVIYSINGKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTQQSIIQRLNNLSAMTAVAGESMSLDKWTLAQPHFSVQKVSDNVSRILVSFKAGKKVTTPGKRYVYRGGKRVLVQEGLLIPRGALCEESVYGRIHSLEKEVPVKKLFERVDDIVKPGIRTAVEERLRACDNDVKVACASLKKEPLYLDVEKTIPLEYGTCYKAKYVMRYALSALKPKDIEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRINSIKSLFALHPRKVSVSLLGEMALKDD

SEQ ID NO: 1107 - protein, 1220 aa, unidentified
  REGION 1..1220: note = Description of Unknown:uncultivated organism with predicted taxonomy: Bacteroides sp.CAG:770
  REGION 1..1220: note = MG16-18 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKSQFGILDESMLESLCKIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRRVVQENILVPRGALSEESVYGRIKSIEEKIPVKKLFERADDIVKPRIRHLIGERLEACGGDCSKAVSSLRKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1108 - protein, 1220 aa, unidentified
  REGION 1..1220: note = Description of Unknown:uncultivated organism with predicted taxonomy: Bacteroides sp.CAG:770
  REGION 1..1220: note = MG16-19 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEISAECESEPLYRLWHIIYSISDKNEQKSALEKQFGITDESMLESLCRIDFVKQGYSGRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENTISQTKRNRLLTPADKIPKDFIARQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRRLIRERLETFGGDCSKAVSSLKKSPLYLDEENTIMLEYGSCFKPEYVIKYSLNSIKAKDAVSIVDKHIREVVTARLAAFGDDPKKAFAEPLYSYASGKIQIKTVRCYTGLSQVVPVKRDADGNDIGFVKPGNNHHIAIYKDADGKYQESIVTFCDAVERKKYGIPVDVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1109 - protein, 1221 aa, unidentified
  REGION 1..1221: note = Description of Unknown:uncultivated organism with predicted taxonomy: Bacteroides sp.CAG:770
  REGION 1..1221: note = MG16-20 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLQEIGRVLYHINQKRGYRHAKSDDSADKEQHDYVQTVNKRYQEIKDEGTTIGQHFAIKLKESEIVTDKGPFYNYRIKEQVFPRDAYIEEFDRIMDCQKTFYPEELSEDNIEEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILDIGKGDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGSKRILAQEGLLIPRGALCEESVYGRINSLEKGVPVKKLFERVDDIVKPGIRTAVEERLRACDNDVKVACASLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQNISSLYYVLRLQYETQVDNSNEALNMKKFHRIRSFNALFALHPRKVSVSLLGEMALKDD

SEQ ID NO: 1110 - protein, 1218 aa, unidentified
  REGION 1..1218: note = Description of Unknown:uncultivated organism with predicted taxonomy: Bacteroides sp.CAG:770
  REGION 1..1218: note = MG16-21 effector
MKKILGLDLGVGSVGWSVVSCDDEHKPVEILGMGSRIVPLTPDESSEFSSGNAASKNQSRTQKRTARKGYDRYQLRRQALTVKLRELGMLPDEALIKLPVLDLWKLRARAATPGEKLSLAEIGRVLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVLTAADVNEIRNEIIYYQRPLKSCKHLVSSCEFMQRELFDAEHNPIRNGKGEIVVAGPKCAPKSSPLAQVCKIWEEINNIRVTNKENDEYFISIDNKHEIFDFLNTHEKMKADDLFKILGIAKNSGWSADRAMSKGMVGNTTRVALMKALKGRRDIDDILRFDLRDVESNQVNADTGEVLMEISAECESEPLYRLWHIIYSISDKNEQKSALKNQFGISDESMLESLCKIDFVKQGYSSRSFKFMRKILPSLMDGAKYSEACDVIGVNHSDSITKAENQARELLARLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYVSRKAMEILNQVCRNVYGSSGDVTAYLRRIWGYDEILHSLDLPRYREGNLTGNVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKSGKRRIAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLDSIKAKDAASIVDKHVREVVTARLAAFGDDPKKAFAEPLYADEAGKIQIKTVRCHTGLSQVVPVKKDADGNDIGFVKPGNNHHIAIYKDADGKYCWNVVTLWNAVDRKRYGLPIIVRNPYEISDIIIDSNVPDELASGLPDPNWSFVMSLQQNEMFVLGMSEEEFRCAIENKDYKTLGMHLYRVQKLSHLRFRSQYETRLDDSNEAKSMKKFYEIRSLKSFWFLNPHKVSISLLGEISLKDD

SEQ ID NO: 1111 - protein, 1220 aa, unidentified
  REGION 1..1220: note = Description of Unknown:uncultivated organism with predicted taxonomy: Bacteroides sp.CAG:770
  REGION 1..1220: note = MG16-22 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEINNIRVTNKENDEYFISIDNKHEIFDFLNTHEKMKADDLFKILGLAKNSGWSADRAMSKGMVGNTTRVALMKALKGRRDIDEILRFELKEVESNQVNADTGEVLMEISAECEREPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYRKGNLTGDVTYVHKGQTHTEERIKDWSKRLDHRHHAIDALTIACTRQSIIQRLNTLNAKTAIGEEQMSLDKWTLAQAHFSVADVADHVADILVSFKSGKRVTTLGKRYVYKAGRRIVAQENILVPRGALSAESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKYIREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 1112 - protein, 1221 aa, unidentified
  REGION 1..1221: note = Description of Unknown:uncultivated organism with predicted taxonomy: Bacteroidales
  REGION 1..1221: note = MG16-23 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNRSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1113 - protein, 1221 aa, unidentified
  REGION 1..1221: note = Description of Unknown:uncultivated organism with predicted taxonomy: Bacteroides sp.CAG:770
  REGION 1..1221: note = MG16-24 effector
MKKVLGLDLGVSSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDYQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDTIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1114 - protein, 895 aa, unidentified
  REGION 1..895: note = Description of Unknown:uncultivated organism with predicted taxonomy: Bacteroides sp.CAG:770
  REGION 1..895: note = MG16-25 effector
MKKILGLDLGVGSVGWSVVSCDDEHKPVEILGMGSRIVPLTPDESNEFSSGNAASKNQSRTQKRTARKGYDRYQLRRQALTGKLRELGMLPDEALIKLPVMDLWTLRARAATPGEKLSLAEIGRVLYHLNQKRGYRHSKEDDSADKTQRDYVQAVNKRFQEIMNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNRKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKNQFGISDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESVKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKKVATPGKRYVYKAGRRRVVQENILVPRGALSEESV

SEQ ID NO: 1115 - protein, 1071 aa, unidentified
  REGION 1..1071: note = Description of Unknown:uncultivated organism with predicted taxonomy: Bacteroides
  REGION 1..1071: note = MG16-26 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTY

SEQ ID NO: 1116 - protein, 1220 aa, unidentified
  REGION 1..1220: note = Description of Unknown:uncultivated organism with predicted taxonomy: Bacteroides sp.CAG:770
  REGION 1..1220: note = MG16-27 effector
MKKILGLDLGVGSVGWSVVSCDDEHKPVEILGMGSRIVPLTPAESNEFSSGNAASKNQSRTQKRTARKGYDRYQLRRQALTVKLRELGMLPDEALIKLPVLDLWTLRARAATPGEKLSLAEIGRVLYHLNQKRGYRHSKEDDSADKTQRDYVQAVNKRFQEIKNEGLTIGQHFAVKLKGSEVITDKGAFYNYRIKEQVFPRAAYVEEFDRIIQCQREFYPEVLTAADVNEIRNEIIYYQRPLKSCKHLVSSCEFMQRELFDAEHNPIRNRKGEIVVAGPKCAPKSSPLAQVCKIWEEINNIRVTNKENDEYFVGIDNKHEIFDFLNTHEKMKADDLFKILGLAKNSGWSADRAMSKGMVGNTTRVALMKALKGRRDIDDILRFDLREVESNQVNADTGEVLMEIGAECESEPLYRLWHIIYSISDKNEQKAALEKQFGITDESMLESLCRIDFVKQGYSSRSFKFMRKILPSLMDGAKYSEACDVIGINHSDSITKAENQTRKLLPKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKGNATAFDYMKGRGENAFEDYLKRVEAAFKENKISQTKRNRLLTPADKIPKDFISRQLVQTQYISRKAMEILDQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKAGSRRVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLDSIKAKDAASIVDKHIRDVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLTGGLPSPEWTFVMSMQQNEMFVLGMGDDEFNDALAGRDYKSLGEHLYRVQKLASSYYVFRSQYETKLDDSKNALMMKKYYRTQSFNALFAINPRKVSISLLGEISLKDD

SEQ ID NO: 1117 - protein, 1219 aa, unidentified
  REGION 1..1219: note = Description of Unknown:uncultivated organism with predicted taxonomy: Bacteroides sp.CAG:545
  REGION 1..1219: note = MG16-28 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDKIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLPRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHTLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPFEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 1118 - protein, 1221 aa, unidentified
  REGION 1..1221: note = Description of Unknown:uncultivated organism with predicted taxonomy: Bacteroides sp.CAG:709
  REGION 1..1221: note = MG16-29 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRKSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLMACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAICRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRVRSFNALFYLHPRKVAVSLLGEMSLKND

SEQ ID NO: 1119 - protein, 1221 aa, unidentified
  REGION 1..1221: note = Description of Unknown:uncultivated organism with predicted taxonomy: Bacteroides sp.CAG:709
  REGION 1..1221: note = MG16-30 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1120 - protein, 1221 aa, unidentified
  REGION 1..1221: note = Description of Unknown:uncultivated organism with predicted taxonomy: Bacteroides sp.CAG:709
  REGION 1..1221: note = MG16-31 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVALSKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACYNDVNAACASLKKEPLYLDAEKTIPLEYGTCYKAKYVMKYALSALKPKDVEYIVDEHIRKVVSERLSEYGNDPKKAFAEPLYADDAKTIDVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1121 - protein, 1219 aa, unidentified
  REGION 1..1219: note = Description of Unknown:uncultivated organism with predicted taxonomy: Alistipes sp.CAG:514
  REGION 1..1219: note = MG16-32 effector
MKKVLGLDLGVGSVGWSLVNVDDNYKPAEILGLGSRIISLSPDESSEFTSGNAASKNQKRTQKRTARKGYDRYQMRRQALTEKLRELKMLPDERLIKLPVLDLWTLRARAATPGEKLTLPEIGRVLYHINQKRGYRHSKSDDSADKEQRDYVQTVNKRFQEIKDEGTTIGQHFAIILKESEVFTEKGPFYNYRIKEQVFPRDAYIEEFDRIMACQKAFYPEELSDININEIRNEIIFYQRNLRSCKHLVSRCEFMTRRFFDAEHKPILNNSGEIVISGPKVAPKSSPIFQACKIWEEINNLSLRNKENDELHISREQKKEIFEYLDNNEKITATALYKILGIGKGDGWSMDKALSKGVTGNTTKTAIARALGKMNNPAKESLLRFDLRLKENGVNKDSGEVIYEIDPECENEPLYRLWHIIYSINDKEALRQALTNQFGINDEESLKELSNIDFVKQGYGSRSAKFMRKLLPALIGGAKYSEACDMIGINHSGSLTKSENEARELLHKIPQLQKNELRQPVVEKILNQMINVVNAVIDQFGDIDEIRVEMARELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQLVQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKKVTTPGKRYIHRGGKRILTQEGLLIPRGALCEESVYGRILSLEKAVPVKKLFERVEDIVKPGIRAMVEERLQACNNDVKVACASLKKEPLYLDAEKTIPLEYGTCYKAEYVMKYTLSALKPKDVEYIVDEHIRKVVSERLSEYGNDPKKAFAEPLYADEAKTIPIRTVRCYTDLRQAAPVKKDANGNDIGFVKPGNNHHIAIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 1122 - protein, 1219 aa, unidentified; identical to SEQ ID NO: 1121
  REGION 1..1219: note = Description of Unknown:uncultivated organism with predicted taxonomy: Alistipes sp.CAG:514
  REGION 1..1219: note = MG16-33 effector

SEQ ID NO: 1123 - protein, 1221 aa, unidentified
  REGION 1..1221: note = Description of Unknown:uncultivated organism with predicted taxonomy: Bacteroides sp.CAG:545
  REGION 1..1221: note = MG16-34 effector
MKKVLGLDLGVGSVGWSLVNVDDNYKPMEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQSVNKRYQEIKDEGATIGQHFAIKLKESEIVTDKGPFYNYRIKEQVFPRDAYIEEFDRIMACQKTFYPEELSDGNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELSKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLMIPRGALCEESVYGRIHSLEKEVPVKKLFERVDDIVKPGIRTAVEERLRACDNDVKVACASLKKEPLYLDAEKTIPLEYGTCYKAEYAMRYALSALKPKDVEFIVDEHIRKVVSERLSEYGNDPKKAFAEPLYADKSKMIPIRTVRCYTGLAQVVPIKKDSNGNDIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEGKDYKTLGAHLYRVQKLTSLYYVFRHQYETQLDDSKGAQIMKKFYRVRSFNAMFALHPRKVSVSLLGEMALKDD

SEQ ID NO: 1124 - protein, 1186 aa, unidentified
  REGION 1..1186: note = Description of Unknown:uncultivated organism with predicted taxonomy: Bacteroides sp.CAG:770
  REGION 1..1186: note = MG16-35 effector
MGSRIVPLTPDESNEFSSGNAASKNQSRTQKRTARKGYDRYQLRRQALTGKLRELGMLPDEALIKLPVMDLWTLRARAATPGEKLSLAEIGRVLYHLNQKRGYRHSKEDDSADKTQRDYVQAVNKRYQEIKNEGLTIGQHFAVKLKESEVITDKGAFYNYRIKEQVFPRAAYVEEFDRIIQCQREFYPEVLTEANVNEIRNEIIYYQRLLKSCKHLVSVCEFMQRELFDAEHNPIRNRKGEIVIAGPKCAPKSSPLAQVCKIWEEVNNIRITNKENDEYFISVDDRHKIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKNQFGISDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIACTRQSIIQKLNTLNAKTAIGEEQISLDKWTLAQAHFSVADVADHVADILVSFKSGKKVATPGKRYVYKAGRRSVAQENILVPRGALSEESVYGRIKSIEEKVPVKKLFERADDIVKPRIRHLIGERLEACGGDCSKAVSSLRKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1125 - protein, 1221 aa, unidentified
  REGION 1..1221: note = Description of Unknown:uncultivated organism with predicted taxonomy: Bacteroides
  REGION 1..1221: note = MG16-36 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGSNHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDKILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYFVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1126 - protein, 1221 aa, unidentified
  REGION 1..1221: note = Description of Unknown:uncultivated organism with predicted taxonomy: Bacteroides sp.CAG:545
  REGION 1..1221: note = MG16-37 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1127 - protein, 1221 aa, unidentified; identical to SEQ ID NO: 1125
  REGION 1..1221: note = Description of Unknown:uncultivated organism with predicted taxonomy: Bacteroides
  REGION 1..1221: note = MG16-38 effector

SEQ ID NO: 1128 - protein, 1220 aa, unidentified
  REGION 1..1220: note = Description of Unknown:uncultivated organism with predicted taxonomy: Bacteroides sp.CAG:770
  REGION 1..1220: note = MG16-39 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEIGAECESEPLYRLWHIIYSISDKNEQKAALEKQFGITDKSMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIYEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRRLIRERLETFGGDCSKAVSSLKKSPLYLDEENTIMLEYGSCFKPEYVIKYSLNSIKAKDAVSIVDKHIREVVTARLAAFGDDPKKAFAEPLYSYASGKIQIKTVRCYTGLSQVVPVKRDADGNDIGFVKPGNNHHIAIYKDADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1129 - protein, 1221 aa, unidentified
  REGION 1..1221: note = Description of Unknown:uncultivated organism with predicted taxonomy: Bacteroides sp.CAG:770
  REGION 1..1221: note = MG16-40 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGRHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKVVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSIIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLKACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLASSYYVFRHQYETQLDDSKCAQIMKKFYRAQSFKALFALHPRKVSVSLLGEMALKDD

SEQ ID NO: 1130 - protein, 1220 aa, unidentified
  REGION 1..1220: note = Description of Unknown:uncultivated organism with predicted taxonomy: Bacteroides sp.CAG:770
  REGION 1..1220: note = MG16-42 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVQDLWTLRARAATLGNKLSLPEIGRVLYHLNQKRGYRHSKQDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSSCEFMQRELFDAEHNPIRNRKGEIVVAGPKCAPKSSPLAQVCKIWEEINNIRVTNKENDEYFISIDNKHEIFDFLNTHEKMKADDLFKILGIAKNSGWSADKAMSKGMVGNTTRVALMKALKGRRDIDEILRFDLREVESNQVNADTGEVLMEIGAECESEPLYRLWHIIYSISDKNEQKAALEKQFGITDESMLESLCRIDFVKQGYSGRSFKFMRKILPSLMDGAKYSEACDVIGINHSDSITKAENQTRKLLTKLPQLQKNELRQPVVEKILNQMINVVNAVIGKYGAIDEIRVEMARELKLSKEGRESAAKNIRAREKANEEIAKRIEELGLLPSKNKILKYRLWEESGKRCFYCGQPVSATEFLNGLDVEIEHVVPKSLLFDDSFSNKVCACRKCNAEKGNATAFDFMNGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHMGQTHTEERIKDWSKRLDHRHHAIDALTIACTRQSIIQRLNTLNAKTAIGEEQMSLDKWTLAQAHFSVADVSDHVADILVSFKSGKKVTTPGKRCVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAASIVDKHIRDVVIARFAAFGDDPKKAFAEPLYADEAGKIQIKTVRCYTGLSQVVPVKKDAAGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDALAGRDYKSLGEHLYRVQKLATSDYFFRSQYETKLDDSKGASAMRKFYRTASLKALFALNPRKVSISLLGEISLKDD

SEQ ID NO: 1131 - protein, 1220 aa, unidentified; identical to SEQ ID NO: 1130
  REGION 1..1220: note = Description of Unknown:uncultivated organism with predicted taxonomy: Bacteroides sp.CAG:770
  REGION 1..1220: note = MG16-43 effector

SEQ ID NO: 1132 - protein, 1232 aa, unidentified
  REGION 1..1232: note = Description of Unknown:uncultivated organism with predicted taxonomy: Bacteroides sp.CAG:770
  REGION 1..1232: note = MG16-44 effector
CGSYRSGLSDRAYISRVHLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIIVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEISAECESEPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAVSIVDNHIREVVTARLAAFGDDPKKSFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 1133 - protein, 1186 aa, unidentified; identical to SEQ ID NO: 1124
  REGION 1..1186: note = Description of Unknown:uncultivated organism with predicted taxonomy: Bacteroides sp.CAG:770
  REGION 1..1186: note = MG16-45 effector

SEQ ID NO: 1134 - protein, 1221 aa, unidentified
  REGION 1..1221: note = Description of Unknown:uncultivated organism with predicted taxonomy: Bacteroides sp.CAG:770
  REGION 1..1221: note = MG16-46 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNLRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSLYYVFRHQYETQLDDSKGAQIMKKFYRVRSFNAMFALHPRKVSVSLLGEMALKDD

SEQ ID NO: 1135 - protein, 1221 aa, unidentified
  REGION 1..1221: note = Description of Unknown:uncultivated organism with predicted taxonomy: Bacteroides sp.CAG:709
  REGION 1..1221: note = MG16-47 effector
MKKILGLDLGVGSIGWSLINADKDNKPIAILGLGSRIISLSPDESSEFTSGNAASKNQKRTQKRTTRKGYDRYQMRRQALTDKLSKLKMLPDEHLIKLPVLDLWTLRARAATPGEKLTLQEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRTLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKSDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHRISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAEYVMKYALSALKPKDVEYIVDEHIRKVVSERLSEYGNDPKKAFAEPLYADDAETIPVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRIQSFKALFALHPRKVAVSLLGEMSLKND

SEQ ID NO: 1136 - protein, 1220 aa, unidentified
  REGION 1..1220: note = Description of Unknown:uncultivated organism with predicted taxonomy: Bacteroides sp.CAG:770
  REGION 1..1220: note = MG16-48 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKCFQEIKDEGLTIGQHFAVKLKESEVITDKGAFYNYRIKEQVFPRAAYVEEFDRIIQCQREFYPDVFTEAIVNEIRNEIIYYQRPLKSCKHLVSVCEFMQRELFDAGHNPIRHRKGEIVVAGPKCAPKSSPLAQVCKIWEEVNNIRITNKENDEYFISIDNKHEIFDFLNTHEKMKADDLFKILGIAKNSGWSADRAMSKGMVGNTTRVALMKALKGRRDIDDILRFDLREVESNQVNADTGEVLMEISAECESEPLYRLWHIIYSISDKNEQKSALKNQFGISDDSMLESLCKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKKVTTPGKRYVYRAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKHVREVVTARLAAFGDEPKKAFAEPLYADVAGKIQIKTVRCYTGLSQVVPVKKDADGNDIGFVKPGNNHHIAIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 1137 - protein, 1191 aa, unidentified
  REGION 1..1191: note = Description of Unknown:uncultivated organism with predicted taxonomy: Bacteroides sp.CAG:770
  REGION 1..1191: note = MG16-50 effector
ILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKCFQEIKDEGLTIGQHFAVKLKESEVITDKGAFYNYRIKEQVFPRAAYVEEFDRIIQCQREFYPDVFTEAIVNEIRNEIIYYQRPLKSCKHLVSVCEFMQRELFDAGHNPIRHRKGEIVVAGPKCAPKSSPLAQVCKIWEEVNNIRITNKENDEYFISIDNKHEIFDFLNTHEKMKADDLFKILGIAKNSGWSADRAMSKGMVGNTTRVALMKALKGRRDIDDILRFDLREVESNQVNADTGEVLMEISAECESEPLYRLWHIIYSISDKNEQKSALKNQFGISDDSMLESLCKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKKVTTPGKRYVYRAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKHVREVVTARLAAFGDEPKKAFAEPLYADVAGKIQIKTVRCYTGLSQVVPVKKDADGNDIGFVKPGNNHHIAIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 1138 - protein, 1220 aa, unidentified; identical to SEQ ID NO: 1136
  REGION 1..1220: note = Description of Unknown:uncultivated organism with predicted taxonomy: Bacteroides sp.CAG:770
  REGION 1..1220: note = MG16-51 effector

SEQ ID NO: 1139 - protein, 1217 aa, unidentified
  REGION 1..1217: note = Description of Unknown:uncultivated organism with predicted taxonomy: Bacteroides sp.CAG:770
  REGION 1..1217: note = MG16-52 effector
MKKILGLDLGVGSVGWSVVSCDDEHKPVEILGMGSRIVPLTPDESNEFSSGNAASKNQSRTQKRTARKGYDRYQLRRQALTVKLRELGMLPDETLIKLPVLDLWTLRARAATPGDKLSLPEIGRVLYHLNQKRGYRHSKQDDSADKTQRDYVQAVNKRFQEIKDEGLTIGQHFAVKLKESELITDKGAFYNYRIKEQVFPRAAYVEEFDRIIQCQREFYPEVFTEAIVNEIRNEIIYYQRPLKSCKHLVSVCEFMQRELFDAGHNPIRNRKGEIVVAGPKCAPKSSPLAQVCKIWEEINNIRVTNKENDEYFISIDNKHEIFDFLNTHEKMKADDLFKILGIAKNSGWSADRAMSKGMVGNTTRVALMKALKGRRDIDDILRFDLREVESNQVNADTGEVLMEIGAECESEPLYRLWHIIYSISDKNEQKAALEKQFGITDKSMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRIVAQENILVPRGALSEESVYGRIKSIEEKVPVKKLFERVDDIVKPRIRRLIRDRLKACGGDCSKAVSSLKKSPLYLDEENTIMLEYGSCFKPEYVIKYSLNSIKAKDAVSIVDNHVREVVTERLAAFGDDPKKAFAEPLYADAAGKIQIRTVRCYTNSTVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1140 - protein, 1221 aa, unidentified
  REGION 1..1221: note = Description of Unknown:uncultivated organism with predicted taxonomy: Bacteroides sp.CAG:709
  REGION 1..1221: note = MG16-53 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRIQSFKALFALHPRKVAVSLLGEMSLKND

SEQ ID NO: 1141 - protein, 1221 aa, unidentified
  REGION 1..1221: note = Description of Unknown:uncultivated organism with predicted taxonomy: Bacteroides sp.CAG:709
  REGION 1..1221: note = MG16-54 effector
MKKILGLDLGVGSIGWSLINADKDNKPIAILGLGSRIISLSPDESSEFTSGNAASKNQKRTQKRTARKGYDRYQMRRSALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRIMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLMACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1142 - protein, 1220 aa, unidentified
  REGION 1..1220: note = Description of Unknown:uncultivated organism with predicted taxonomy: Bacteroides sp.CAG:770
  REGION 1..1220: note = MG16-55 effector
MKKILGLDLGVGSVGWSVISCDDEHRPLEILGMGSRIVPLTPDESNEFSSGNAASKNQSRTQKRTARKGYDRYQSRRKALTDKLRDLDMLPDETLIKLPVLDLWTLRARAATPGDKLSLPEIGRVLYHLNQKRGYRHSKQDDSADKTQRDYVQAVNKRFQDIKDEGLTIGQHFAEKLKESEIITDKGAFYNYRIKEQVFPRAAYVEEFDRIIQCQRGFYPEVLTEANVNEIRNEIIYYQRPLKSCKHLVSVCEFMQRELFDADHNPIRNGKGEIVVAGPKCAPKSSPLAQVCKIWEEINNIRVTNKENDEYFISIDNKHEIFDFLNTHEKMKADDLFKILGLAKNSGWSADRAMSKGMVGNTTRVALMKALKGRRDIEEVLRFDLRAVESNQVNADTGEVLMEISAECEREPLYRLWHIIYSISDKNEQKSALKNQFGISDESMLESLYKIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSATEFLNGLDVEIEHVIPKSLLFDDSFSNKVCACRKCNAEKGNATAFDFMKGRGENAFEDYLKRVETAFKENRISQTKRSRLLTPADKIPKDFISRQLVQTQYISRKAMDILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKAAIGEEQMSLDKWTLAQAHFSVADVADHVADILVSFKSGKKVATPGKRYVYRAGSRNVAQENILVPRGALSEESVYGRIKSIEEKVPVKKLFERVDDIVKPRISHLICERLEACGGDCSKAVSSLKKSPLYLDEENTIMLEYGSCFKPEYVIKYSLNSIKAKDAVSIVDNHVREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEELARGLPSPEWTFVMSMQQNEMFVLGMGDDEFNDAMAGRDYKSLGEHLYRVQKLATSDYFFRSQYETKLDDTKNALSMKKYYRTRSFKALFALNPHKVSISLLGEISLKDD

SEQ ID NO: 1143 - protein, 1219 aa, unidentified
  REGION 1..1219: note = Description of Unknown:uncultivated organism with predicted taxonomy: Bacteroides sp.CAG:545
  REGION 1..1219: note = MG16-56 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAMGKALGKEHNTKKSDLLRFDLRLKENGVNKDTGEIIYEIDPACENEPLYRLWHVIYSINDKDALRHALTNQFGINDGESLRKLTKIDFVKQGYGSRSAKFMRKLLPALMDGARYSEACDMIGINHSDSLTKSENEARELLHKIPQLQKNELRQPVVEKILNQMINVVNAVIEQFGSIDEIRVEMARKLKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPFEYGTCYKAEYVMRYALSALKPKDVEFIVDEHIRKVVSERLSEYGNDPKKAFAEPLYADKSKTIPIRALRCYTGLAQVVPVKKDSKGNDIGFVKPGNNHHIAIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 1144 - protein, 1220 aa, unidentified; identical to SEQ ID NO: 1108
  REGION 1..1220: note = Description of Unknown:uncultivated organism with predicted taxonomy: Bacteroides sp.CAG:770
  REGION 1..1220: note = MG16-57 effector

SEQ ID NO: 1145 - protein, 1223 aa, unidentified
  REGION 1..1223: note = Description of Unknown:uncultivated organism with predicted taxonomy: Bacteroides sp.CAG:770
  REGION 1..1223: note = MG16-58 effector
MKKILGLDLGVGSVGWSVISCDDEHRPREILGMGSRIVPLTPDESNEFSSGNAASKNQSRTQKRTARKGYDRYQSRRKALTDKLRELDMLPDEALIKLPVLDLWTLRARAATPGDKLSLPEIGRVLYHLNQKRGYRHSKQDDSADKTQRDYVQAVNKRFQEIKDEGLTIGQHFAEKLKDSEIITDKGAFYNYRIKEQVFPRAAYVEEFDRIIQCQREFYPEVLTEANVNEIRNEIIYYQRPLKSCKHLVSVCDFMQRELFDADHNPIRNGKGKIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVGSNQVNADTGEVLMEISAECEREPLYRLWHIIYSISDKNEQKSALKNQFGISDDSMLESLCKIDFVKQGYSSRSFKFMRKILPSLMDGAKYSEACDVIGINHSDSITKAENQARELLTRLPQLQKNELRQPVVEKILNQMINVVNAVIDKYGAIDEIRVEMARELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKRVTTPGKRYVYKTGRRIVAQENILVPRGALSEESVYGRIKSIEEKVPVKKLFERVDDIVKPRIRYLIRERLETFGGDCSKAVSSLKKSPLYLDEENTIMLEYGSCFKYSYVKKSKLIQLDKKDDFINVSLIVDKHIREVVTARLAAFGGDTKKAFAEPLYADEAGKIQIRTVRCYTNSTVVTVKKDADGNDIGFVKPGNNHHIAIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 1146 - protein, 1221 aa, unidentified
  REGION 1..1221: note = Description of Unknown:uncultivated organism with predicted taxonomy: Bacteroides sp.CAG:770
  REGION 1..1221: note = MG16-59 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISLEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNNTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLEHRHHAIDALTIACTRQSIIQRLNNLSAMTAVAGESMSLDKWTLAQPHFSVQEVSDNVSRILVSFKAGKKVTTPGKRYVYRGGKRVLAQESLLIPRGALCEESVYGRIHSLEKEVPVKKLFERVDDIVRPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVMCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIYYVFRHQYETQLDDSKGAQIMKKFYRAQSFKALFALHQRKVSVSLLGEMALKDD

SEQ ID NO: 1147 - protein, 1221 aa, unidentified
  REGION 1..1221: note = Description of Unknown:uncultivated organism with predicted taxonomy: Bacteroides sp.CAG:770
  REGION 1..1221: note = MG16-60 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGSNHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYFVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNISEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1148 - protein, 1221 aa, unidentified
  REGION 1..1221: note = Description of Unknown:uncultivated organism with predicted taxonomy: Bacteroides sp.CAG:709
  REGION 1..1221: note = MG16-61 effector
MKKILGLDLGVGSIGWSLINADKDNKPIAILGLGSRIISLSPDESSEFTSGNAASKNQKRTQKRTTRKGYDRYQMRRQALTDKLSKLKMLPDEHLIKLPVLDLWTLRARAATPGEKLTLQEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRDLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLEVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKEEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFIFGMEDDEFMDAMAEADYKALGAHLYRVQKLAGSDYYFRSHYETLLDDSAGARIMKKFYRISSSKALFALHPRKVAVSLLGEMSLKND

SEQ ID NO: 1149 - protein, 1221 aa, unidentified
  REGION 1..1221: note = Description of Unknown:uncultivated organism with predicted taxonomy: Bacteroides sp.CAG:770
  REGION 1..1221: note = MG16-62 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKLGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1150 - protein, 1221 aa, unidentified
  REGION 1..1221: note = Description of Unknown:uncultivated organism with predicted taxonomy: Bacteroides sp.CAG:770
  REGION 1..1221: note = MG16-63 effector
MKKVLGLDLGVGSVGWSLVNVDDNYKPTEILGIGSRIISLSPDESSEFTSGNAASKNQKRRQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKGALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1151 - protein, 1219 aa, unidentified
  REGION 1..1219: note = Description of Unknown:uncultivated organism with predicted taxonomy: Alistipes sp.CAG:514
  REGION 1..1219: note = MG16-64 effector
MKKVLGLDLGVGSVGWSLVNVDDNYKPAEILGLGSRIISLSPDESSEFTSGNAASKNQKRTQKRTARKGYDRYQMRRQALTEKLRELKMLPDERLIKLPVLDLWTLRARAATPGEKLTLPEIGRVLYHINQKRGYRHSKSDDSADKEQRDYVQTVNKRFQEIKDEGTTIGQHFAIILKESEVFTEKGPFYNYRIKEQVFPRDAYIEEFDRIMACQKAFYPEELSDININEIRNEIIFYQRNLRSCKHLVSRCEFMTRRFFDAEHKPILNNSGEIVISGPKVAPKSSPIFQACKIWEEINNLSLRNKENDELHISREQKKEIFEYLDNNEKITATALYKILGIGKGDGWSMDKALSKGVTGNTTKTAIARALGKMNNPAKESLLRFDLRLKENGVNKDSGEVIYEIDPKCENEPLYRLWHIIYSINDKEALRQALTNQFGINDEESLKELSNIDFVKQGYGSRSAKFMRKLLPALIGGAKYSEACDMIGINHSGSLTKSENEARELLHKIPQLQKNELRQPVVEKILNQMINVVNAVIDQFGDIDEIRVEMARELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQLVQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKKVTTPGKRYIHRGGKRILTQEGLLIPRGALCEESVYGRILSLEKAVPVKKLFERVEDIVKPGIRAMVEERLQACNNDVKVACASLKKEPLYLDAEKTIPLEYGTCYKAEYVMKYTLSALKPKDVEYIVDEHIRKVVSERLSEYGNDPKKAFAEPLYADEAKTIPIRTVRCYTDLRQVAPVKKDANGNDIGFVKPGNNHHIAIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 1152 - protein, 1220 aa, unidentified
  REGION 1..1220: note = Description of Unknown:uncultivated organism with predicted taxonomy: Bacteroides sp.CAG:770
  REGION 1..1220: note = MG16-65 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVTTPGKRYVYKAGRRRVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKAKDAVSIVDKHVREVVTARLAAFGDDPKKAFAEPLYADEAGKIQIKTVRCYTGLSQVVPVKKDADGNDIGFVKPGNNHHIAIYKDAGGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1153 - protein, 1221 aa, unidentified
  REGION 1..1221: note = Description of Unknown:uncultivated organism with predicted taxonomy: Bacteroides sp.CAG:770
  REGION 1..1221: note = MG16-66 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNAHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGEYMSLDKWTLAQPHFSVQEVSDNVSRILVSFKAGKKVTTPGKRYVYRGGKRILAQEGLLIPRGALCEESVYGRIHSLEKEVPVKKLFERVDDIVRPGIRAAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRNVEGTYHESIVTFWDSVERKKYGLPVIIRKPGEIWDILIDKNIPEELAAGLPAPDWQFVMSMQQNEMFVLGMEDDEFRDAMEVKNYKTLGAHLYRVQKLASIDYYFRSQYETALDNSAGARMMKKFYRINSIKSLFALHPRKVSVSLLGEMALKDD

SEQ ID NO: 1154 - protein, 1221 aa, unidentified
  REGION 1..1221: note = Description of Unknown:uncultivated organism with predicted taxonomy: Bacteroides sp.CAG:545
  REGION 1..1221: note = MG16-67 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEGNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAMAKALGKEHNTKKSDLLRFDLRLKENGVNKDTGEIIYEIDPACENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAERTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1155 - protein, 1221 aa, unidentified; identical to SEQ ID NO: 1109
  REGION 1..1221: note = Description of Unknown:uncultivated organism with predicted taxonomy: Bacteroides sp.CAG:770
  REGION 1..1221: note = MG16-68 effector

SEQ ID NO: 1156 - protein, 1221 aa, unidentified; identical to SEQ ID NO: 1120
  REGION 1..1221: note = Description of Unknown:uncultivated organism with predicted taxonomy: Bacteroides sp.CAG:709
  REGION 1..1221: note = MG16-69 effector

SEQ ID NO: 1157 - protein, 1221 aa, unidentified
  REGION 1..1221: note = Description of Unknown:uncultivated organism with predicted taxonomy: Bacteroides sp.CAG:770
  REGION 1..1221: note = MG16-70 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKVLSKGFTGNTTKGAIAKALGKDHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGVNHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYDTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALNDD

SEQ ID NO: 1158 - protein, 1219 aa, unidentified; identical to SEQ ID NO: 1117
  REGION 1..1219: note = Description of Unknown:uncultivated organism with predicted taxonomy: Bacteroides sp.CAG:545
  REGION 1..1219: note = MG16-72 effector

SEQ ID NO: 1159 - protein, 1221 aa, unidentified
  REGION 1..1221: note = Description of Unknown:uncultivated organism with predicted taxonomy: Bacteroides sp.CAG:545
  REGION 1..1221: note = MG16-73 effector
MKKVLCLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEVGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLSLKENGVNKDTGEIIYEIDPACENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWQFVMSMQQNEMFVLGMKDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 1160 - protein, 1220 aa, unidentified
  REGION 1..1220: note = Description of Unknown:uncultivated organism with predicted taxonomy: Bacteroides sp.CAG:770
  REGION 1..1220: note = MG16-74 effector
MKKILGLDLGVGSVGWSVISCDDEHRPLEILGMGSRIVPLTPDESNEFSSGNAASKNQSRTQKRTARKGYDRYQSRRKALTDKLRDLDMLPDETLIKLPVLDLWTLRARAATPGDKLSLPEIGRGLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEKVNNIRITNKENDEYFISIDNKHEIFDFLNTHEKMKADDLFKILGIAKNSSWSADRAMSKGMVGNTTRVALMKALKGRRDIDEILRFDLREVESSQVNADTGEVLMEISAECEREPLYRLWHIIYSISDKNEQKSALKNQFGISDDSMLESLCKIDFVKQGYSSRSFKFMRRILPSLMDGAKYSEACDVIGINHSDSITKAENQARELLTRLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNANTAIGEEQISLDKWTLAQAHFSVADVADHVADILVSFKSGKKVATPGKRYVYRAGRRIVAQENILVPRGALSEESVYGRIKSIEEKVPVKKLFERADDIVKPRIRHLIGARLEACGGDCSKAVSSLRKSPLYLDEEKTIMLEYGSCFKPEYVIKYSLNSIKAKDAVSIVDNHVREVVTARLAAFGDDPKKAFAEPLYADEAGKIQIKTVRCYTGLSQVVPVKKDADGNDIGFVKPGNNHHIAIYKNADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1161 - protein, 1221 aa, unidentified; identical to SEQ ID NO: 1119
  REGION 1..1221: note = Description of Unknown:uncultivated organism with predicted taxonomy: Bacteroides sp.CAG:709
  REGION 1..1221: note = MG16-75 effector

SEQ ID NO: 1162 - protein, 1219 aa, unidentified
  REGION 1..1219: note = Description of Unknown:uncultivated organism with predicted taxonomy: Bacteroides
  REGION 1..1219: note = MG16-76 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1163 - protein, 1220 aa, unidentified
  REGION 1..1220: note = Description of Unknown:uncultivated organism with predicted taxonomy: Bacteroides sp.CAG:770
  REGION 1..1220: note = MG16-77 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDFADKTQRDYVQAVNKRFQEIKNEGLTIGQHFAVKLKESEVITDNGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPSLMDSAKYSEACDVIGINHSDSITKAENQTRKLLTKLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKRVTTPGKRYVYKAGRRIVVQENILVPRGALSEESVYGRIKSIEEKVPVKKLFERVDDIVKPRIRRLIRERLEACGGDCSKAVSSLKKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDALAGRDYKSLGEHLYRVQKLASLYYVFRSQYETKLDDSKGALTMKKFYRTASFKALFSLNPRKVSISLLGEISLKDD

SEQ ID NO: 1164 - protein, 1221 aa, unidentified
  REGION 1..1221: note = Description of Unknown:uncultivated organism with predicted taxonomy: Bacteroides
  REGION 1..1221: note = MG16-78 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSLLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRSVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1165 - protein, 1221 aa, unidentified
  REGION 1..1221: note = Description of Unknown:uncultivated organism with predicted taxonomy: Bacteroides sp.CAG:770
  REGION 1..1221: note = MG16-79 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHRISFIKRSRLLTPADKLPKDFISRQLIQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 1166 - protein, 1221 aa, unidentified; identical to SEQ ID NO: 1134
  REGION 1..1221: note = Description of Unknown:uncultivated organism with predicted taxonomy: Bacteroides sp.CAG:545
  REGION 1..1221: note = MG16-80 effector

SEQ ID NO: 1167 - protein, 1221 aa, unidentified
  REGION 1..1221: note = Description of Unknown:uncultivated organism with predicted taxonomy: Bacteroides
  REGION 1..1221: note = MG16-81 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDVILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADKSKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1168 - protein, 1221 aa, unidentified
  REGION 1..1221: note = Description of Unknown:uncultivated organism with predicted taxonomy: Bacteroides sp.CAG:770
  REGION 1..1221: note = MG16-82 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKRDIFEYLDNNEKINATALYKILDIGKCDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKLLKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGSKRILAQEGLLIPRGALCEESVYGRINSLEKGVPVKKLFERVDDIVKPGIRTAVEERLRACDNDVKVACASLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQKLTSIYYVFRHQYETQLDDSKGAQIMKKFYRAQSFKALFALHPRKVSVSLLGEMALKDD

SEQ ID NO: 1169 - protein, 1221 aa, unidentified
  REGION 1..1221: note = Description of Unknown:uncultivated organism with predicted taxonomy: Bacteroides sp.CAG:545
  REGION 1..1221: note = MG16-83 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERIDDIVKPGIRAAVEERLRACDNDVKVACASLKKEPLYLDVEKTIPLEYGTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIDYYFRSQYETALDNSAGARMMKKFYRINSIKSLFTLHPRKVSVSLLGEMALKDD

SEQ ID NO: 1170 - protein, 1165 aa, unidentified
  REGION 1..1165: note = Description of Unknown:uncultivated organism with predicted taxonomy: Bacteroidetes
  REGION 1..1165: note = MG16-84 effector
MQTRKILGLDLGVGSVGWALIETEDDQPKSILAMGSRIVPLSSDDSTKFQKGQAITKNAERTQKRTMRKGLNRYQIRRALLTDLLRRNGMLPEYMNENVIDLWQLRSDAATEGKQLSLPQIGRVLYHINQKRGYKHSKADISADAKQTKYVEAVNQRYRNIQALHQTIGQYFCQQLKETAVQTEKGVYYTFRIKEKVLPRASYVAEFDQIMKVQQSYYPNVLTDELIDTLRNHIIFYQRPLKSCKHLVGLCEFEMRPYKRNDGQIVYGGPKCAPRTSPLAQLCAVWEAVNNITLTNRSNETLEITPKQRKAMADFLYEHEKMGVKDLQKILGISPKDGWWAGKAIGKGIKGNTTYTQLRDALGPISNAADLLSMKIELTDSMVDTTTAELIRQVSPNVEEQPLYRLWHIVYSAQNEDDLRKALHKQFDIEDEKVVANLGKIDFVKPGYANKSNKFMRKLLPYLMQGYKYNEACAHIGVNHSNSLTAEQNTVRPLLDKIPLLEKNALRQPVIEKILNQMINVVNALKAEFGDIDDVRIELARELKESKDERESAFKRNNENERKNKEYEARIREYGIRPSRSRIQKYKMWEESQKKCFYCGKTIDVVEFLNGVDAEIEHIIPQSVLFDDSFSNKVCSCRDCNHTKGNLTAREFMEQHSAADYEAYLRRVDEAFDEHRISKTKRDHLLWRKEDIPQDFIDRQLRQSQYIAKKAAEILRQGVRNVYATSGSVTDFLRHQWGYDNILHYLNLPRYQQVDGLTESVTYDHCGQKHQEERIKDWTKRLDHRHHAIDALTIALTQQSVIQRLNTLNASREEMKNDLGQRIDTPEYTEKRSLLEKWVDIQPHFSVQEVTDKVDGILISFRAGKRVATPAKRAIYQQRKRCIVQTGLQVPRGALSEETVYGKLGNKYVVKYALTHPSMKVDDIVDPTIREIVRNRLNAFGGNVKDAFAESLYSDVAHKMQIKSVRCYTNLQDKAVSAVRFNAQGEPVGFVKMGNNHHIAIYCDKKGQYQESVVSFWHAVERKRYGIPVVIEKPQEVWDKLIDIDAIPQDFLENLPKDDWQFVVSLQQNEMFILGMDEADYEAAMEQKDYRTLNKYLYRVQKISSKEYYFRYHTETSVDDKYEGKNNPNISIELQKLKRIKSFGALFSQHPHKVRINLLGEISAL

SEQ ID NO: 1171 - protein, 1221 aa, unidentified
  REGION 1..1221: note = Description of Unknown:uncultivated organism with predicted taxonomy: Bacteroides
  REGION 1..1221: note = MG16-85 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKGYKTLGAHLYRVQNISSLYYVLRLQYETQVDNSNEALNMKKFHRIRSFNALFALRPRKVSVSLLGEMALKDD

SEQ ID NO: 1172 - protein, 1221 aa, unidentified
  REGION 1..1221: note = Description of Unknown:uncultivated organism with predicted taxonomy: Bacteroides sp.CAG:545
  REGION 1..1221: note = MG16-86 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHIRPEQKKDIFEYLDNNEKINATTLYKILDIGKGDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHLGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGGKRILAQEGLLIPRGALCEESVYGRINSLEKGVPVKKLFERVDDIVKPGIRTAVEERLRACDNDVKVACVSLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYLRSQYETTLDDSAGARMMKKFYRIKSIKSLFALHPRKVSVSLLGEMALKDD

SEQ ID NO: 1173 - protein, 1221 aa, unidentified; identical to SEQ ID NO: 1172
  REGION 1..1221: note = Description of Unknown:uncultivated organism with predicted taxonomy: Bacteroides
  REGION 1..1221: note = MG16-87 effector

SEQ ID NO: 1174 - protein, 1219 aa, unidentified
  REGION 1..1219: note = Description of Unknown:uncultivated organism with predicted taxonomy: Bacteroides
  REGION 1..1219: note = MG16-88 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKKVTTPGKRYVYRGGKRILAQKGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAEPLYADKSKTIPIRAARCYTDLRQVAPVKKDANGNNIGFVKPGNNHHIAIYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 1175 - protein, 1221 aa, unidentified; identical to SEQ ID NO: 1118
  REGION 1..1221: note = Description of Unknown:uncultivated organism with predicted taxonomy: Bacteroides sp.CAG:709
  REGION 1..1221: note = MG16-89 effector

SEQ ID NO: 1176 - protein, 1223 aa, unidentified
  REGION 1..1223: note = Description of Unknown:uncultivated organism with predicted taxonomy: Bacteroides sp.CAG:770
  REGION 1..1223: note = MG16-90 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDADHNPIRNGKGKIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVGSNQVNADTGEVLMEISAECEREPLYRLWHIIYSISDKNEQKSALKNQFGISDDSMLESLCKIDFVKQGYSSRSFKFMRKILPSLMDGAKYSEACDVIGINHSDSITKAENQARELLTRLPQLQKNELRQPVVEKILNQMINVVNAVIDKYGAIDEIRVEMARELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKRVTTPGKRYVYKAGRRIVAQENILVPRGALSEESVYGRIKSIEEKVPVKKLFERVDDIVKPRIRYLIRERLETFGGDCSKAVSSLKKSPLYLDEENTIMLEYGSCFKYSYVKKSKLIQLDKKDDFINVSLIVDKHIREVVTARLAAFGGDTKKAFAEPLYADEAGKIQIRTVRCYTNSTVVPVKKDADGNDIGFVKPGNNHHIAIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 1177 - protein, 1223 aa, unidentified; identical to SEQ ID NO: 1176
  REGION 1..1223: note = Description of Unknown:uncultivated organism with predicted taxonomy: Bacteroides sp.CAG:770
  REGION 1..1223: note = MG16-91 effector

SEQ ID NO: 1178 - protein, 1219 aa, unidentified; identical to SEQ ID NO: 1151
  REGION 1..1219: note = Description of Unknown:uncultivated organism with predicted taxonomy: Alistipes sp.CAG:514
  REGION 1..1219: note = MG16-92 effector

SEQ ID NO: 1179 - protein, 1219 aa, unidentified; identical to SEQ ID NO: 1151
  REGION 1..1219: note = Description of Unknown:uncultivated organism with predicted taxonomy: Alistipes sp.CAG:514
  REGION 1..1219: note = MG16-93 effector

SEQ ID NO: 1180 - protein, 1221 aa, unidentified
  REGION 1..1221: note = Description of Unknown:uncultivated organism with predicted taxonomy: Bacteroides sp.CAG:545
  REGION 1..1221: note = MG16-94 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSYNVSRILVSFKAGKKVTTPGKRYVYRGGKRILAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDPKGNDIGFVKPGNNHHIAIYRDAEGTYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETALDNSAGARMMKKFYRINSIKSLFALHPRKVSVSLLGEMALKDD

SEQ ID NO: 1181 - protein, 1221 aa, unidentified
  REGION 1..1221: note = Description of Unknown:uncultivated organism with predicted taxonomy: Bacteroides sp.CAG:709
  REGION 1..1221: note = MG16-95 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPILDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENCVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQIHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1182 - protein, 1189 aa, unidentified
  REGION 1..1189: note = Description of Unknown:uncultivated organism with predicted taxonomy: Bacteroides
  REGION 1..1189: note = MG16-96 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKISQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKMIPIRAVRCYTSLAQVAPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMK

SEQ ID NO: 1183 - protein, 1221 aa, unidentified
  REGION 1..1221: note = Description of Unknown:uncultivated organism with predicted taxonomy: Bacteroides
  REGION 1..1221: note = MG16-97 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPKELSEDNIDEIRNKIIFYQRDLKSCKHLVSQCEFMTRSFLDANHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFSSIDEIRVEMARELKLSKEGRAATAKNIRNREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGVLCEESVYGRIHSLEKEVPVKKLFERVDDIVKPGIRAAVEERLRAYDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKSGEIWDILIDKNIPEELAAGLPAPDWKFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1184 - protein, 1220 aa, unidentified
  REGION 1..1220: note = Description of Unknown:uncultivated organism with predicted taxonomy: Bacteroides sp.CAG:770
  REGION 1..1220: note = MG16-98 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVLDLWTLRARAATPGEKLSLAEIGRVLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVFTEAIVNEIRNEIIYYQRPLKSCKHLVSVCEFMQRELFDAEQNPIRNRKGEIVVAGPKCAPKSSPLAQVCKIWEEINNIRVTNKENDEYFISIDNKHEIFDFLNTHEKMKADDLFKILGIAKNSGWSADKAMSKGMVGNTTRVALMKALKGRRDIDEILRFDLREVESNQVNADTGEVLMEIGAECESEPLYRLWHIIYSISDKNEQKAALEKLFGITDESMLESLCRIDFVKQGYSGRSFKFMRKILPSLMDGAKYSEACDVIGINHSDSITKAENQTRKLLTKLPQLQKNELRQPVVEKILNQMINVVNAVIGKYGAIDEIRVEMARELKLSKEGRESAAKNIRAREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKSGRRIVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKTKDAASIVDKHIREVVTARLAAFGDDPKKAFAEPLYADEAGKIQIKTVRCYTGLCQVVPVKKDAAGNDIGFVKPGNNHHIAIYKDADGKYQESIVTFCDAVERKKYGIPVVVRNPAAVLDTIIDKNVPEDLAGGLPSPEWTFVMSMQQNEMFVLGMGDDEFNDAMAGMDYKSLGEHLYRVQKLATSDYFFRSQYETKLDDTKNALSMKKYYRTRSFKALFALNPHKVSISLLGEISLKDD

SEQ ID NO: 1185 - protein, 1219 aa, unidentified
  REGION 1..1219: note = Description of Unknown:uncultivated organism with predicted taxonomy: Bacteroides sp.CAG:709
  REGION 1..1219: note = MG16-99 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQSHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRDSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLKACDNDVNAACASLKKEPLYLDAEKTIPLEYGTCYKAEYVMKYALSALKPKDVEYIVDEHIRKVVSERLSEYGNDPKKAFAEPLYADKSKTIPIRAARCYTDLRQVAPVKKDANGNNIGFVKPGNNHHIAFYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 1186 - protein, 1221 aa, unidentified
  REGION 1..1221: note = Description of Unknown:uncultivated organism with predicted taxonomy: Bacteroides sp.CAG:709
  REGION 1..1221: note = MG16-100 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKVVISGPKVAPKSSPIFQVCKIWEEINNLSIRNKENDELHISPEQKKEIFEYLDNNEKITSAALYKILGIGKGDGWSVDKALSKGFTGNTTKVAISKSLGKANDAKKRDLMRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACNVIGVNHSGSLTKSENEARELLQRIPQLQKNELRQPVVEKILNQMINVVNAVIEKFGGVDEIRVEMARELKLSKEGRAATAKNIRDREKENKEIAEKIIELDVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKACDNDVKAACTSLKEEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILSMEDDEFRDAMAEADYKALGAHLYRVQKLTGSDYYFRSHYETLLDDSAGARIMKKFYRVRSFNALFNLHPRKVSVSLLGEMALKDD

SEQ ID NO: 1187 - protein, 1221 aa, unidentified
  REGION 1..1221: note = Description of Unknown:uncultivated organism with predicted taxonomy: Bacteroides sp.CAG:545
  REGION 1..1221: note = MG16-101 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLSEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEETNNLSIRNKENDELHISPEQKKDIFEYLDNNEKINATALYKILGIGKGDGWSVDKALSKGFTGNTTKVAMAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTSEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKDVPVKKLFERVDDIVKPGIRAAVEERLRACDNDVKVACASLKKEPLYMDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1188 - protein, 1220 aa, unidentified
  REGION 1..1220: note = Description of Unknown:uncultivated organism with predicted taxonomy: Bacteroides sp.CAG:770
  REGION 1..1220: note = MG16-102 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKQDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDDILRFDLREVESNQVNSDTGEVLMEISAECESEPLYRLWHIIYSISDKNEQKAALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYCSSGDVTAYLRRIWGYDEILHSLDLPRYREGNLTGDVTYVHMGQTHTEERIKDWSKRMDHRHHAIDALTIACTRQSIIQRLNTLNAKTAIGEEQMSLDKWTLAQAHFSVADVADHVADILVSFKSGKRVTTLGKRYVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKYIREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 1189 - protein, 1220 aa, unidentified
  REGION 1..1220: note = Description of Unknown:uncultivated organism with predicted taxonomy: Bacteroides sp.CAG:770
  REGION 1..1220: note = MG16-103 effector
MKKILGLDLGVGSVGWSVVSCDDEHKPVEILGMGSRIVPLTPDESNEFSSGNAASKNQSRTQKRTARKGYDRYQSRRKALTDKLRELDMLPDETLIKLPVLDLWTLRARASTPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQRKFYPEVLTEANVNEIRNEIIYYQRPLKSCKHLVSVCEFMQRELFDADHNPIRNGKGKIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEIGAECESEPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAVSIVDNHIREVVTARLAAFGDDPKKSFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 1190 - protein, 1221 aa, unidentified; identical to SEQ ID NO: 1119
  REGION 1..1221: note = Description of Unknown:uncultivated organism with predicted taxonomy: Bacteroides
  REGION 1..1221: note = MG16-104 effector

SEQ ID NO: 1191 - protein, 1220 aa, unidentified
  REGION 1..1220: note = Description of Unknown:uncultivated organism with predicted taxonomy: Bacteroides sp.CAG:770
  REGION 1..1220: note = MG16-105 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKNEGLTIGQHFAEKLKESEIITDKGSFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEINNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEISAECEREPLYRLWHIIYSISDKNEQKSALKNQFGISDESMLESLYKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFIARQLVQTQYISRKAMEILNQVCRNVYGSSGDVTAYLRRIWGYDEILHSLDLPRYREGNLTENVTYVHRGQTHTEERIKDWSKRLDHRHHAIDALTIACTRQSIIQRLNTLNAKTAIGEEQMSLDKWTLAQTHFSVADVADHVADILVSFKSGKRVTTPGKRYVYKAGRRRVAQENILVPRGALSEESVYGRIKSIEEKVPVKKLFERVDDIVKPRIRRLIRERLEACGGDCSKAVSSLKKSPLYLDEENTIMLEYGSCFKPEYVIKYSLNSIKAKDAVSIVDKHIREVVIARLAAFGDDPKKAFAEPLYADEAGKIQIKTVRCYTGLSQVVPVKKDADGNDIGFVKPGNNHHIAIYKDADGKYQESIVTFRDVVERKKYGIPVVVRNPAAVLDTIIDKNVPEDLAGGLPSPEWTFVMSMQQNEMFVLGMGDDEFNDAMSGMDYKSLGEHLYRVQKLASLYYVFRSQYETKLDDSKGALTMKKFYRTASFKALFALNPRKVSISLLGEISLKDD

SEQ ID NO: 1192 - protein, 1221 aa, unidentified
  REGION 1..1221: note = Description of Unknown:uncultivated organism with predicted taxonomy: Bacteroides sp.CAG:545
  REGION 1..1221: note = MG16-106 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVLPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTQKSDLLRFDLRLKENGVNKDTGEIIYEIDPTCENEPLYRLWHVIYSINDKDALRHALTNQFGINDGESLRELSKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLDKEVPVKKLFERIDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYKDAEGTYHESIVTFWDSVERKKYGLPVIIRKPGEIWDIIIDKNIPEELAAGLPAPDWQFVMSMQQNEMFVLGMEDDGFRDAMEVKDYKTLGAHLYRVQKLTSIDYYFRSQYETTLDDSAGARMMKKFYRIKSIKSLFALHPRKVSVSLLGEMALKDD

SEQ ID NO: 1193 - protein, 1221 aa, unidentified
  REGION 1..1221: note = Description of Unknown:uncultivated organism with predicted taxonomy: Bacteroides sp.CAG:545
  REGION 1..1221: note = MG16-107 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEAREFLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1194 - protein, 1220 aa, unidentified; identical to SEQ ID NO: 1111
  REGION 1..1220: note = Description of Unknown:uncultivated organism with predicted taxonomy: Bacteroides sp.CAG:770
  REGION 1..1220: note = MG16-108 effector

SEQ ID NO: 1195 - protein, 1221 aa, unidentified
  REGION 1..1221: note = Description of Unknown:uncultivated organism with predicted taxonomy: Bacteroides sp.CAG:709
  REGION 1..1221: note = MG16-109 effector
MKKILGLDLGVGSIGWSLINADKDNKPIAILGLGSRIISLSPDESSEFTSGNAASKNQKRTQKRTARKGYDRYQMRRQSLTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAEPLYADDAKTIPIRAVRCYTGLAQVVPVKKDSKGNDIGFVKPGNNHHIAIYRDADGAYHENVVTFWDTVERKKYGLPVIIRKPGEIWDILIDKNIPEELAAGLPAPDWKFVMSMQQNEMFVLGMEDDEFRDAMEVKDYKTLGAHLYRVQKLASSYYVFRHQYETQLDDSKCAQIMKKFYRAQSFKALFALHPRKVSVSLLGEMALKDD

SEQ ID NO: 1196 - protein, 1221 aa, unidentified; identical to SEQ ID NO: 1195
  REGION 1..1221: note = Description of Unknown:uncultivated organism with predicted taxonomy: Bacteroides sp.CAG:709
  REGION 1..1221: note = MG16-110 effector

SEQ ID NO: 1197 - protein, 1221 aa, unidentified; identical to SEQ ID NO: 1150
  REGION 1..1221: note = Description of Unknown:uncultivated organism with predicted taxonomy: Bacteroides sp.CAG:770
  REGION 1..1221: note = MG16-113 effector

SEQ ID NO: 1198 - protein, 1221 aa, unidentified
  REGION 1..1221: note = Description of Unknown:uncultivated organism with predicted taxonomy: Bacteroides sp.CAG:545
  REGION 1..1221: note = MG16-114 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQESLLIPRGALCEESVYGRIHSLEKEVPVKKLFERVDDIVRPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLACIYYVFRHQYETQLDDSKGAQIMKKFYRAQSFKALFALRQRKVSVSLLGEMALKDD

SEQ ID NO: 1199 - protein, 1221 aa, unidentified
  REGION 1..1221: note = Description of Unknown:uncultivated organism with predicted taxonomy: Bacteroides sp.CAG:770
  REGION 1..1221: note = MG16-115 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKKSEIVTDKGPFYNYRIKEQVFPRDAYIEEFDRIMDCQKTFYSEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1200 - protein, 1221 aa, unidentified
  REGION 1..1221: note = Description of Unknown:uncultivated organism with predicted taxonomy: Bacteroides
  REGION 1..1221: note = MG16-116 effector
MKKVLGLDLGVGSVGWSLVNVDDNYKPTEILGIGSRIISLSPDESSEFTSGNAASKNQKRTQKRTTRKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKAEYVMRYALSALKPKDVEFIVDEHIRKVVSERLSEYGNDLKKAFAEPLYADKSKTIPIRAVRCYTGLAQVVPVKKDSKGNAIGFVKPGNNHHIAIYKDADGTYHENVVTFWDTVERKKYGLPVIIRKPGEIWDILIDKNIPEELAAGIPAPDWKFVMSMQQNEMFVLGMEDDEFRDTMEVKDYKTLGAHLYRVQKLTSIYYVFRHQYETQLDDSKGAQIMKKFYRAQSFKALFSLHPRKVSVSLLGEMALKDD

SEQ ID NO: 1201 - protein, 1220 aa, unidentified
  REGION 1..1220: note = Description of Unknown:uncultivated organism with predicted taxonomy: Bacteroides sp.CAG:770
  REGION 1..1220: note = MG16-118 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSSKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVTTPGKRYVYKAGRRRVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKAKDAVSIVDKHVREVVTARLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISMLGEISLKDD

SEQ ID NO: 1202 - protein, 1221 aa, unidentified
  REGION 1..1221: note = Description of Unknown:uncultivated organism with predicted taxonomy: Bacteroides sp.CAG:709
  REGION 1..1221: note = MG16-119 effector
MKKILGLDLGVGSIGWSLINADKDNKPIAILGLGSRIISLSPDESSEFTSGNAASKNQKRTQKRTARKVYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKAYDNDVKAACTSLKEEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1203 - protein, 1221 aa, unidentified; identical to SEQ ID NO: 1135
  REGION 1..1221: note = Description of Unknown:uncultivated organism with predicted taxonomy: Bacteroides sp.CAG:709
  REGION 1..1221: note = MG16-120 effector

SEQ ID NO: 1204 - protein, 1223 aa, unidentified
  REGION 1..1223: note = Description of Unknown:uncultivated organism with predicted taxonomy: Bacteroides sp.CAG:770
  REGION 1..1223: note = MG16-121 effector
MKKILGLDLGVGSVGWSVISCDDEHRPLEIVGMGSRIVPLTPDESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQDIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDADHNPIRNGKGKIVVAGPKCAPKSSPLARVCKIWEEINNIRVTNKENDEYFISIDNKHEIFDFLNTHEKMKADDLFKILGIAKNSGWSADRAMSKGMVGNTTRVALMKALKGRRDIDDILRFDLRDVESNQVNADTGEVLMEISAECESEPLYRLWHIIYSISDKNEQKSALKNQFGISDESMLESLCKIDFVKQGYSSRSFKFMRKILPSLMDGAKYSEACDVIGVNHSDSITKAENQARELLARLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGHGENAFEDYLKRVETAFKENRISQTKRNRLLTPADKIPKDFISRQLVQTQYISRKAMEILNQVCRNVYGSSGDVTAYLRRIWGYDEILHSLDLPRYREGNLTGDVTYLHKGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKYSYVKKSKLIQRDKKDDCINVSLIVDKHIREVVTARLAAFGGDTKKAFAEPLYADEAGKIQIKTVRCYTNSTVVPVKKDADGNDIGFVKPGNNHHIAIYKDADGKYQESIVTFRDAVERKKYGIPVVVRNPVEVMDTVIDKNVPEDLAGGLPSPEWTFVMSMQQNEMFVLGMGDDEFNDAMAGMDYKSLGEHLYRFQSISHADYYFRSQYETMLDNSKNAMAMKKYYRIRSFKALFALNPRKVSISLLGEISLKDD

SEQ ID NO: 1205 - protein, 1220 aa, unidentified
  REGION 1..1220: note = Description of Unknown:uncultivated organism with predicted taxonomy: Bacteroides sp.CAG:770
  REGION 1..1220: note = MG16-122 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDVIGVNHSDSITKAENQARELLTRLPQLQKNELRQPVVEKILNQMINVVNAVIDKYGAIDEIRVEMARELKLSKAGRESAAKNIRTREKANEEIAKRIEELGLVPSKNKILKYRLWEEFGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKRVTTPGKRYVYKAGRRRVVQENILVPRGALSEESVYGRIKSIEEKVPVKKLFERVDDIVKPRIRYLIRERLETCGGDCSKAVSSLKKSPLYLDEENTIMLEYGSCFKPEYVIKYSLNSIKAKDAVSIVDNHIREVVTARLAAFGDDPKKAFAEPLYADGAGKIQIRTVRCYTGLSQVVPVKKDADGNDIGFVKPGNNHHIAIYKDADGKYQESIVTFCDAVERKKYGIPVVVRNPVEALDTIIDKNVPEDLAGGLPSPEWTFVMSMQQNEMFVLGMGDDEFNDALAGMDYKSLGEHLYRVQKLATSDYFFRSQYETKLDDSKGASAMRKFFRTASLKALFALNPRKVSISLLGEISLKDD

SEQ ID NO: 1206 - protein, 1221 aa, unidentified
  REGION 1..1221: note = Description of Unknown:uncultivated organism with predicted taxonomy: Bacteroides sp.CAG:545
  REGION 1..1221: note = MG16-123 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRTNSIKSLFALHPRKVSVSLLGEMALKND

SEQ ID NO: 1207 - protein, 1221 aa, unidentified
  REGION 1..1221: note = Description of Unknown:uncultivated organism with predicted taxonomy: Bacteroides sp.CAG:770
  REGION 1..1221: note = MG16-126 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLDLWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSDELVISGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLCGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMAAVAGESMSLDKWTLAQPHFSVQEVSDNVSRILVSFKAGKKVTTPGKRYVYRGGKRILAQEGLLIPRGALCEESVYGRIHSLEKGVPVKKLFERVDDIVKPVIRAAVEERLRACDNDVKVACASLKKEPLYLDAEKTIPLEYGTCYKAEYVMKYALSALKPKDVEYIVDEHIRKVVSERLSEYGNDPKKAFAEPLYADKSKTIPIRAVRCYTGLAQVVPVKKDSKGNDIGFVKPGNNHHIAIYRDADGTYHENVVTFWDTVERKKYGLPVIIRKPGEIWDIIIDKNIPEELATCLPAPDWQFVMSMQQNEMFVLGMEDDEFRDAMEGKDYKTLGAHLYRVQKLTSIDYYFRSQYETTLDDSAGARMMKKFYRIKSIKSLFALHPRKVSVSLLGEMALKDD

SEQ ID NO: 1208 - protein, 1221 aa, unidentified
  REGION 1..1221: note = Description of Unknown:uncultivated organism with predicted taxonomy: Bacteroides sp.CAG:709
  REGION 1..1221: note = MG16-127 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNERITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKAYDNDVNAACASLKKEPLYLDAEKTIPLEYGTCYKREYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLAGSDYYFRSHYETLLDDSAGARIMKKFYRISSSKALFALHPRKVAVSLLGEMSLKND

SEQ ID NO: 1209 - protein, 1221 aa, unidentified
  REGION 1..1221: note = Description of Unknown:uncultivated organism with predicted taxonomy: Bacteroides sp.CAG:770
  REGION 1..1221: note = MG16-128 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDVEKTIPLEYGTCYKAKYVMRYALSALKPKDVEFIVDEHIRKVVSERLSEYGNDPKKAFAEPLYADKSKMIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1210 - protein, 1221 aa, unidentified
  REGION 1..1221: note = Description of Unknown:uncultivated organism with predicted taxonomy: Bacteroides sp.CAG:709
  REGION 1..1221: note = MG16-129 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYREGKRILAQDGLLIPRGALSEESVYGRISALEKNVLVKKLFERVEDIVKPGIRAVVEDRLMACDNDVNAACASLKEEPLYLDAEKTIPLEYGTCYKREYVIKYPISSLKTKDVESIIDGHIRQIVSERLSEYGNDPKKAFAEPLYADDAKTIPVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQSLSRSDYYYRCQYETQLDNSNGAMRMKKFYRVRSFNALFNLHPRKVAVSLLGEMSLKND

SEQ ID NO: 1211 - protein, 1220 aa, unidentified
  REGION 1..1220: note = Description of Unknown:uncultivated organism with predicted taxonomy: Bacteroides sp.CAG:770
  REGION 1..1220: note = MG16-130 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRYSKEDDSADKTQRDYVQAVNKRFQEIKNEGLTIGQHFAVKLKASEVITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEINNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEISAECEREPLYRLWHIIYSISDKNEQKSALKNQFGISDESMLESLCKIDFVKQGYSSRSFKFMRKILPSLMDGAKYSEACDVIGINHSDSITKAENQIRKLLTKLPQLQKNELRQPVVEKILNQMINVVNAVIDKYGAIDEIRVEMARELKLSKAGRESAANNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKAGRRRVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKTKDAASIVDKHVREVVTERLAAFGDDPKKAFAEPLYADEVGKIQIKTVRCYTGLSQVVPVKKDADGNDIGFVKPGNNHHIAIYKDADGKYQECIVTFRDAVERKKYGIPVVVRNPVEALDTIIDKNVPEDLAGGLPSPEWTFVMSMQQNEMFVLGMGEDEFNDAMAGMDYKSLGEHLYRVQKLASSDYFFRSQYETKLDDTKNALLMKKYYRTRSFKALFALNPHKVSISLLGEISLKDD

SEQ ID NO: 1212 - protein, 1221 aa, unidentified
  REGION 1..1221: note = Description of Unknown:uncultivated organism with predicted taxonomy: Bacteroides sp.CAG:709
  REGION 1..1221: note = MG16-131 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFVSRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSMQEVSDKVGGILVSFKAGKKVTTPGKRYTYRRGKRILAQDGLLIPRGALSEESVYGRISALEKNVLVKKLFERVEDIVKPGIRAVVEDRLKACDDDVKAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1213 - protein, 1221 aa, unidentified
  REGION 1..1221: note = Description of Unknown:uncultivated organism with predicted taxonomy: Bacteroides
  REGION 1..1221: note = MG16-132 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRALRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1214 - protein, 1257 aa, unidentified
  REGION 1..1257: note = Description of Unknown:uncultivated organism with predicted taxonomy: Bacteroidales
  REGION 1..1257: note = MG16-133 effector
MKKILGLDLGTTSIGWALINAEDNNKPTEIQDIGVRIVPLAENEGDKFTKGQDITVNADRTRARGQRRNYDRFQLRRQALTEKLRSLDMLPDEHLIKLPVMELWQLRANAVTQKVSLNELGRVLYHLNQKRGYKHSRTDSNDSKQRAYVKEINNRYAELQKLGMTIGQYFAQKLEETAIKQNGKIFYAFRIKEQIYPRQAYEEEYDAIMKCQQTFYPEILTESIIEEIRNRIIYYQRDLRSCKHLVTVCEFEKRCFYDADGNVKRNQKGEIIYDGPKVVPRTSPLFQVFKNWQSINNIRFHNRKNEYLFITKEQKQQIANVMANQEVLKLKDVQEILGVTSKSGWYCDKAIKAGIKGNITKCAIIASLSSLPQSKIREITRFNLETETTNMVDEETGELLVRIKNTYQEEPLYKLWHIIYSIKNDNERLNTIISFLKDFDIEDISISNALNDLDFVTPGYANLSAKAISKILPYMMEGLDYSDSCEYVGYNHSDSLTKEENENRILLDKIPALKKNELRQPTVEKILNQTISIFNEINANLLQKGERVDEVRIELARELKQSKEEREKTDRGIRKQQKANEVFANLLKEQGVRPTRNRILKYRLWRESYETCFYCGQPISFKEFLKFSDVEREHVIPKRLLYDDSFANQVCSCRKCNAEKGGRTAIDYMRTTQHLQPYLEKVDKMFQEHKISGKKHAHLLASYDDYLSRKKEGKETKDDIIIWEEAIERQLRLSQYISKKAQELLKKSCREVIATSGSVTDLIRHTWGYDTILHELNLPCYKEAGLTTFIKEENTGQQKEVIKDWTKRLDHRHHAVDALTVACTSRSIIQHINTLHASREVMRGDVKTPRKEWENNDLLQQWIKEKMPFDRQYVLQKVASILVSMKSGKKSTVPGKRKIYIKGKPIVMQSGLRIPRGQLHEQTVYGAIKQYSKDKKGNLIEKKEIVTRYKMGVGSVGFVFNGKETCDVVFDKKNNRYVIADGIDKAINYIIDKHIRDIVRERLNEAFPDGETYRTEAEIALAAGKTYNGKERSMKALEQLKALYEQPLYADKNKHIVIKSVRCFTGLSAVQPLRYNDKNEPTSFVLTKNNHHVAIYLDEKGELKECIYTFWQAVERSKYKLPLIIKEPKSLWDEILERENNGEIFPDTLITSLPSPNWTFVESLQLNDMFVMDMDDVKFENFISSNNYEEIGKRIYRVQSLSSHDYVFRHHTDTTSSMMPEAALCRKFIRIKSLKAYIEHHPHKVQLSLLGKILTKR

SEQ ID NO: 1215 - protein, 1243 aa, unidentified
  REGION 1..1243: note = Description of Unknown:uncultivated organism
  REGION 1..1243: note = MG16-134 effector
MKKILGLDLGTNSIGWAVVNADENGNPVSIEGMGSRIVPLTADDTNEFTKGNAISKNQSRTEKRTARKGYDRYQLRRNKLTLEFRKLNMLPDEQLIKLQPLELWQLRATAATEGHKLTLPEIGRVLYHINQKRGYKHAKSDESADTKQKAYVAEVNARYAMIKERKQTIGQFFAEKLKENEIETSKGKLYTYRIKEQVFPRRAYEAEFDQIMECQRVFYPDVLTNEEINRLRNEIIFYQRKLKSCKHLVSLCEFEKREYKNKDGKIVIDGPKVAPKSSPLFQVCKIWEEINNITLRNRRNDELYISMDQRQAMFDFLDTHEKMTLSDLYSILGISKNDGWWGGKAIGKGLQGNTTKIALKNALGDFENADNLLQFKLESIDSNFVDEETGEIIQIINPNLEKEPLYDLWHTVYSISDKEELANALKKKFNINDEDIINNLYAIDFVKPGYGNKSAKAIRRILPYLQQGLKYSDACEYAGFRHSESLTKTENEQRQLLDKLPAIQKNALRQPIVEKILNQMINVVNALMVEYKEHFYSIRVELARELKQSKDDRNTTYLQNEAMERLNDAIAKRLNSEGIKTTKRILEKYKYIFPTKGCIDKKTGKFVSKNFENLSTVNQCIYCGKSFSLTAALNGDGYEVEHIIPRDLICDNSQSNKVLSCRSCNSKKSNKTAFDFMRGQGEQALEDYIARIEKWYKDGIISPAKREHLLLSHEDYLKRKKEGKTTDEDKKYWEDFVSRQAGETQYISREAIKILKQCCKNVNATSGAVTAILRHLWGYDEILHQLDFERYKKAGLTKIVTWESDHGKNKHTKEQIVNWTKRIDHRHHAIDALVIACTQQGFVQRINTLNADETKDLMKKQIESSGVKFEEKKDLLNKYLASLTPFSTQTVADNVDKILVSFKAGKKSASTGKRIKYVKGKKVVLQKGIIIPRGALHEEGVYGQIEINGKKEIVKKYKLGKGAQGFVFTGKETYEKKVNNKTGEIHVVDKIKNVLDSIVDVNIRSKILQRLNQGFEDGKDYRDDVKKALDNLNDLDKNPIFADDNNTIPIRTVRCRTGLSAVVPIKHNEKGEPIGFVKPGNNHHIAIYSDKNGNLHEHTVTFWHAVERKKYGIPVIIENPQSVWDSIIDKQLPESFLENLPDVKWTFEISLQQNEMFVLGMENESFEDAVRNNDFSTISKYLYRVQSISESDYWFRLHIETQNDKTPSAKLANKYHRVKSLKSFHELNPHKVYISVIGKIKAL

SEQ ID NO: 1216 - protein, 1078 aa, unidentified
  REGION 1..1078: note = Description of Unknown:uncultivated organism with predicted taxonomy: Porphyromonassp. oral taxon 278
  REGION 1..1078: note = MG16-135 effector
MKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIIECQKEFYPDILTNEEINRLRNEIIFYQRRLKSCKHLVSFCDFEKREYINKVGKVVYGGPKVAPKSSPLFQLCKIWEEVNNLTLRNRKNDELFITIEQRQAMVDFLDTHEKLTLSDMYSILGISKQDGWWGGKAIGRGLQGNTTKIALKKALGDFVNADTLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFDSIRVELARELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKRKDKATDIDKKYWEDFVSRQAGETQYISREAIRILKQCCRYVNATSGSITATLRHLWGYDEILHQLNFERYKQAGLTKIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGGIQIEDKIKNVLDSIVDSNIRAKVLQRLNQGFEEGQDYRNNVKKALDNLNNLDDNPIFADKNNTIPIRTVRCRTGLSAVVPIKKNERGEAIGYVKP

SEQ ID NO: 1217 - protein, 1217 aa, unidentified
  REGION 1..1217: note = Description of Unknown:uncultivated organism with predicted taxonomy: Bacteroidales
  REGION 1..1217: note = MG16-136 effector
MRKILGLDLGVGSIGWSLIETDAEDNPKAILGMGSRIVPLSTDDANEFSSGNAISKNQKRTQKRTQRKGYDRYQLRRALLTQKLRELGMLPDERLIKLPVLELWQLRADAATPGKQLELKEIGRVLYHINQKRGYRHSRSDDGEDKSQKDYVQQVNQRYREILDEGTTIGQHFSKKLADNEVITPKGKFYTYRIKEQVFPRDAYVEEFDRIMECQRRFYPDLLTESTIREIRDEIVFFQRPLKSCKHLVSVCEFAMREYKTKEGKSILAGPKVAPRSSPLFQVCKIWESVNNLSLKNRSGEVYHFSQEERRKMFDFLDNHDKMAVTDLYKLLGISKKEGWWGGKAIGKGLQGNTTKAALAKALGERQDLLQFQLETIDSRQIDTETGEVLKTISPSFEKEPLYRLWHILYSMHERSEVAAALERQFGITAPDTVDRLFAIDFVKAGYGNKSARFIREILPYLQAGMQYSQACDYIGINHSNSLTIEENASRVLLDRLPQLQKNELRQPVIEKILNQMVAVVNALLSQYGPIDEIRVELARELKQSRDERNDAYLSINKRERENKVIEERIREYGISPSKSRIQKYRLWEESNHLCFYCGHPVGAAEFLSGSGVEIEHIIPRSLLFDDSFANKVCACRQCNAEKGNSTAFDYMKSKPANDFEDYLKRVEKYFTEKRISKTKRERLLTPASEIPQDFIDRQLRQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKMVATPGKRYTYKNGKKELVQDGLLIPRGALSEESVYGQITTIEPSVPVKKLFEDPSLIFKPYIRELVERRIKECGGDWKKARASIGKKPIWLDTEETVALEFATCWKKEYVIKYPVSSLKAKDVDSIVDRHIREIVRKRIDEVGEKEAFKTPIYTDDAQSIPLRSVRLFTGLDAVEPVKYVDGVPVGFSKPGNNHHIAIYRDQDGNRSEHVVSFWHAVERKRYGLPVIIRDTDSVWEQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPRKVRISVTGELIPIQ

SEQ ID NO: 1218 - protein, 1045 aa, unidentified
  REGION 1..1045: note = Description of Unknown:uncultivated organism with predicted taxonomy: Prevotella
  REGION 1..1045: note = MG16-137 effector
MKKILGLDLGTTSIGWALVNVDDNNNPVDIQDIGVRRVPLSENEGDKFTKGQDITVNADRTRARGTRRNYDRYQLRRQALTEKLRQLNMLPDENLIMLPIMDLWQLRADAVTKKVSLNELGRILYHLNQKRGYKHSRTDANDSKQREYVKEINNRYAKLLESKMTIGQLFANKLAETAVVQDGKIFYNYRIKDQIYPRNAYEEEYDAIMKCQQKFYPEILTDAIIDEIKNRIIYYQRDLRSCKHLVSICEFEKRCFYDEDGNVKRNKKGDIFYDGPKVAPRTSPLFQVFKDWQSINNLRFHNRRNEYLYITKEQKEQIADFMEHHEILKLKDVQSLLDITAKSGWYCDKAIKAGIKGNSTKCAILSSLSSLPHSKIAEITRFNLETETTNIVDEETGEMLVRIRNTYQNEPLYRLWHIIYSIKNDNERINAISKFLKEFEVEEETVINSLKDIDFVTPGYANLSAKAICKILPYMMEGLDYSDSCEYVGYNHSDSLTKEENEKRELLDKIPALKKNELRQPTVEKILNQTINVFNQINEDLSKDGERISEVRVELARELKQSKDERNETEIGIRKQQKLNDEYAKILKEEGVRPTRNRILKYRLWRESNKSCFYCEQPISFHEFLDFSETEREHIIPKKLMYDDSFANQVCSCRNCNKEKGGRTAMDYMRTKQNLQFYLDKVDKMFQDHKISGKKRSHLLASYDDYLFRKENGKETKDDILIWEKPIERQLRLSQYISRKAQELLRMTCRDVTVTTGEITALIRHTWGYDTILHDLNFSSYKEAGLTEIVKGEDSGRTREIIKDWSKRLDHRHHAIDALAVACTSRSIVQRINTLNASREEIRGEIKAPRKEWKDSNLLQQWIKEKMPFDRQYVLHKVASILISMKAGKKATVPGKRKIYKKGKPIVIQTGLRIPRGQLHEKTVYGAINQYDKGQKVMKIVTRYKMGVGSMGYVFNGKETCDVIKKKNRYEIVDGIQKALDYIVDKHIREIVKARMNEAFPEGETYLTEAEKALAEGKAYDGKARCQKALDQLRTLSERPLYADK

SEQ ID NO: 1219 - protein, 1217 aa, unidentified
  REGION 1..1217: note = Description of Unknown:uncultivated organism
  REGION 1..1217: note = MG16-138 effector
MKRILGLDLGVGSIGWSLIQADEDGNPQSIIDIGCRIVPLSPDDTNEFSSGNAISKNRKRAQKRSVRKGYDRYQLRRQNLTDELRGLGMLPDERLIKLPILALWQLRANAATPGKRLTLPEIGRIFYHINQKRGYLHSKSDEEDKNQRDYVQAINNRYATIKAEGKTIGQYFAQKLADSEVTTDKGKVYAFRIKEQVFPRQAYQEEFDQIIACQRIHYPEVLTDDVIHRLRDEIIFYQRPLKSCKHLVSLCEFAMREYKTTDGRSIQAGPKVTPRSSPLFQVCKIWESVNNIELKNRDGESYPFSAEERLKLFNFLDNNEKMTVTDLKRILGLGTKDKWWGGKAIGKGLQGNITKMALKKALPYHEELLSFNLKSIESRHIDTETGDILLEIAPDFEQEPLYRLWHIIYSMKDPDEMASALNRQFGIDDPTILTNLTRIDFVKAGYGNKSARFIRQILPYLQKGMKYSEACDYISINHSNSLTTAENNSRELLPHMQQLQKNELRQPVIEKILNQMVNVVNALLDKYGSIDEVRVELGRELKQSRDERNSAFLNNNKRERDNKAISERIQEMGIRASRSRILKYRLWEEAKHICFYCGQTVGVKEFLEGTDVEIEHIIPRSLFFDDSFSNKVCACRKCNAEKGNRTAYDYMKQKSDNDFADYTRRIEDAYEKKEISKTKRERLLTTAKDIPEDFIDRQLRQSQYISKKAVEMLKQVCRNVWTTSGSVTDFIRHQWGYDNILHDLNFKRYKDAGQTEIIISDHLGQVHQEERIKNWTKRLDHRHHAIDALTIASTKQSYIQRLNHLNSSRDKMFQELEAQSKEVKEKYSLLESWMRCRPHIPVSVVSQAIDGILVSFKTGKRITTPGKRFIYKSGKREVAQYGIAVPRGALSEESVYGSISCLEANVPVKKLFEHPEIIFKPYIREKVEKRINEFSGDWKAALKSLKKTPIFLRADGTEPLEYATCWKREYVIRYPLASLLKKDLPFIVDRNIRRLVSERINAVGEKDAFKEPLFADKADINPIRSVRLFTGLTQDSLSPVKYFNGYPIGYSKPGNNHHFCYYRNKNGELFEHIVSFWHAVDRKKYGIPVIIEDTDVLWEDMANRDLPQDFLKNLPPAGLKLEVSLQQNEMFVLGMPEEDFQNAIKENDQRALNKYLFRVQKISGQYNVFRRNTDTGKDEDSKAQSLGQFVRISSVRGWIHCCPHKVRISVLGEISEI

SEQ ID NO: 1220 - protein, 930 aa, unidentified
  REGION 1..930: note = Description of Unknown:uncultivated organism with predicted taxonomy: Bacteroidales
  REGION 1..930: note = MG16-139 effector
MKKKILGLDLGVGSIGWALIKTDDNQPKQIIGMGSRIVPISKDDNDQFSKGQAISKNADRTARRTTRKGYDRYQLRRALLTDVLRQNGMLPERMDEHVIDLWKLRSDAATEGHQLTLPQIGRVLYHINQKRGYKHAKADDNGDSKQTKYVEAVNQRYTDLQAEGLTIGQHFHLELLHSKVEGASGPYYTFRIKDKVFPRAAYIAEFDQIMRVQRVYYPEILTDELIDVLRNRIIFYQRPLKSCKHMVSLCEFEMRPYKTKDGRIVYGGPKCAPRTSPLAQFCAMWETANNITLTNRNNERYEFTLDARAQIVKHLCEHAVLKLTDLYKILGITKKDGWWGGKAIGKGIKGNATLNQLRDALDGKYGEWLEMPVEIEDKVNDATGEVVKTVSAEVEHAPLFQLWHAVYSLQNADELAKTLREKFQITDEAVIEALCKIDFVKPGYANKSHKFIRRILPYLMDGYMYNEACAKVGINHSNSMTAAERDARPLAERIELLQKNALRQPVIEKIINQMINLVNRLQQEYGPIDEARVELARELKQSRDERESAYKAINKNERENSTIANRILEDYGIRPSRSRIQKYRMWEESKQRCFYCGKMIDVKQFLSGADVEIEHIVPRSILFDDSYSNKVCACRECNQEKGNLTAMEYMEGKPTGEFEAYKQRVDEAFSEHRISKTKRDHLLWRRADIPQDFIERQLRQSQYIAVKAVEILQQGIRRVWTSGGSVTDFLRHQWGYDEILHTLNLPRYKQVDEMTEWVHYEHAGQEHEVERIKNWTKRLDHRHHAIDALTVALTQQSMIQRLNTLEASHDEMEKQVKEANTPYKEKKSILEKWVTEQPHFEVSEVTDKVDSILVSFRAGKRVTTPARRAIYQGGKRTIVQTGIQVPRGALTEETIYGKSGDKFVVKYPLDHPSMKPENIVDPTIRALVEK

SEQ ID NO: 1221 - protein, 830 aa, unidentified
  REGION 1..830: note = Description of Unknown:uncultivated organism with predicted taxonomy: Fibrobacter
  REGION 1..830: note = MG16-140 effector
MKKILGLDLGVSSIGWSVISVDKNGDPSEILGMGSRIVPLSTDDANEFSTGNAISKNQKRTQKRTARKGYDRYQLRRENLTAELRKHQMLPDERLIKLPVLDLWTLRANAATEGCKLSLPEIGRVLYHINQKRGYKHAKADEAGDKKQTEYIENVNKRFAMIKELGLTIGQFFANKLKESEVVSEKGTFYTYRTKEQVFPRGAYIAEFDQIIEVQRKFYPQVFTDEFINRLRNEIIFYQRNLKSCKHLVSLCEFEKREYKNKDGKIVFDGPKVAPRTSPLFQICRIWEFVNNIRLENGYKEARVLSQEERLKVVDFLDNHEKMTAKDFTKLLRLDKNDEWDLKRYFGKNGVQGNTTKAQLVTALANIPNACEFLRFNLALENSNYVNESTGEILKVISSNFQNEPLYMLWHTVYSLSDKEELKNALNKKYGITDESVLNNLFKIDFIKPGSGNKSAKAIRRILPFLQDGLVYSDACAEAGYNHSNSLTKSENEARTLLSRLPQIKKNELRQPVIEKILNQMVNVVNAIYDEYGQIDEIRVELARELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQLRQTQYIAKKALEMLKEICYNVYATSGSVTDFIRRTWGYDEILHQLNFDRYKKGGLTELREYEHKGETHTEERIQDWSKRLDHRHHAIDALVIAMTRQSIIQRLNHLNTERDAMFQEVEKQRKDWKN

SEQ ID NO: 1222 - protein, 797 aa, unidentified
  REGION 1..797: note = Description of Unknown:uncultivated organism with predicted taxonomy: Bacteroidales
  REGION 1..797: note = MG16-141 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSGAATEGHQLTLPQIGRVLYHINQKRGYKHAKADDNGDSKQTKYVEAVNQRYKEIQEAKQTIGQHFYLELLRSKVESGSGPYYTFRIKDKVFPRAAYIAEFDQIMKVQRAYYPDVLTDELIDTLRNRIIFYQRPLKSCKHLVSLCEFEMKPYKTKDGKIVYGGPKCAPRTSPLAQFCAMWETANNITLTNRNNEQYDFSLEERRQIVEHLCTHEALKLTDLYKILGITKKDGWYGGKAIGKGIKGNATLNQLRKALNGKYGEWLEMPIERVDVVDNETAEVFWQVSPKVEETPLFKLWHAVYSIQDADELAKTLRNKFGIDDQDVIEALCKIDFVKPGYANKSHKFIRRLLPYLMEGMMYSEACARIGINHSNSMTAAERDARPLAERIELLQKNALRQPVIEKILNQMINLVNRLQQEYGPIDEARVELARELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPAAEVEAYKQRVDEAFKEGRISKTKRDHLLWHKSDIPTDFIDRQLRQSQYIAVKAVEILQQGIRQVWTSGGSVTDFLRHQWGYDEILHTLNLPRYRKVEDLTEIVHYEHAGQEHDEERIKNWSKRIDHRHHAIDALTVALTRQAY

SEQ ID NO: 1223 - protein, 1154 aa, unidentified
  REGION 1..1154: note = Description of Unknown:uncultivated organism with predicted taxonomy: Bacteroidales
  REGION 1..1154: note = MG16-142 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGSYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKALNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMKIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1224 - protein, 1048 aa, unidentified
  REGION 1..1048: note = Description of Unknown:uncultivated organism with predicted taxonomy: Deminuibactersoli
  REGION 1..1048: note = MG16-143 effector
YCDLLQICIGKYDVFFRLFKQMRKILGLDLGVGSIGWSLIETDANDNPVAILGIGSRIVPLSTDDANEFSSGNAISKNQKRTQKRTQRKGYDRYQLRRALLTEKLRESGMLPDERLIKLPVLDLWQLRANAATPGKQLELKEIGRVLYHINQKRGYRHSRYDDGDEKSQREYVQQVNQRFRDIRDEGVTIGQHFANKLAENEVTTPKGKFYTYRIKEQVFPREAYVEEFDRIMDCQRGFYPDILTDSTIGVIRDEIIFYQRPLKSCKHLVSVCEFAMREYKTSDGKSVLSGPKVAPRSSPLFQVCKIWESINNLSLKNRSGQVYRFSDEDRQKMFDFLDNHDRMTVTDLYKLLSISKKDGWWGGKAIGKGLQGNTTKAALAKVLGSRSELLRFQLETIDSKRIDTETGEILKVISPSFEKEPLYRLWHIVYSMHERSEVAAALERQFGITDPETVDKLFSIDFIKAGYGNKSARFIREILPYLQVGMQYSDACNYIGINHSNSLTTEDNASRVLLDKLPQLKKNELRQPVIEKILNQMVAVVNALLSQFGPIDEIRVELARELKQSRDERNDAFLKNNKRERENKVIEERIREYGITPSRSRIQKYRLWEESNHLCFYCGQPVGAAEFLSGSGVEIEHIIPRSLLFDDSYANKVCSCRKCNAEKGNSTAYDYMKAKPEGDFEDYLKRIEKFFSEKRISKSKREKLLTPASEIPQDFIDRQLRQSQYIAKKAVDMLKQVCRNVWTTSGSVTDFLRHNWGYDQILHDLNLPRYKEGGMTEMVHYEHNGQEHDEERIIGWTKRLDHRHHAIDALTIASTRQSYIQRLNTLYASRDAMHAEIKKQSAHWQEKHSLLEEWTKQRPHLPVSVVRDSVDGILVSFKPGKRVATPGKRYTYKGKKELIQDGLLIPRGALSEESVYGQITTLEEHVPVKRLFEDPSLIFKPYIRHLVEQRIEEFHGDWKKARLSIGKKPIWLDEGETVALEYATCWKKEYVIRYPVSSLKAKDVNSIVDRHIREIVRKRIDEVGEKDAFKTPLFSDATQMIPVNGIR

SEQ ID NO: 1225 - protein, 1244 aa, unidentified
  REGION 1..1244: note = Description of Unknown:uncultivated organism with predicted taxonomy: Bacteroidales
  REGION 1..1244: note = MG16-144 effector
MKRILGLDLGTTSIGWAVINVDDNLKPVSIESMGSRIVPLSSDDTNEFTKGNAISKNQSRTERRTSRKRYDRYQLRRKYLTAELRKLKMLPDERLIKLPTLELWELRANAASKGHQLTLPELGRVLYHINQKRGYKHAKSDDSSDTKQKAYVAEVNARYSMIKEKNQTIGQYFAEKLKESEVVTPKGKFYTYRTKEQVFPRKAYEAEFDQIMECQKVFYPNLLTEKEISKLRNEIIFYQRNLKSCKHLVSVCDFEKKEYKNKEGKIVFGGPKVAPKSSPLFQICKIWEEVNNLTLKNRKNEELYISLEQRQAMVDFLDTHEKMTLNDMYTILGISKKDGWWGGKAIGRGLQGNTTKIALMNALGNSENVKSLFQFNLHKIDSQLVDEVTGEIIQIIDPKLEKEPLYDLWHTIYSISDKEEFAKALKKKYNITDETIINGLYSIDFVKPGFGNKSAKSIRRILPYLQEGLKYSDACEYAGFRHSESLSKAENETRTLLDELPHINKNELRQPIVEKILNQMINVVNALMNEYGKFDSIRVELARELKQSKDERNTTFLQNEAMQRLNESIAKRLVSENINPTKRIIDKYKFIFPTKGCFDKRTGKFITKNFESLSTVNRCIYCGQSFSLSEALNGDGYEIEHILPRDLICDNSQNNKVLSCRKCNSIKSNKTAFDYMRTQDKNAFEAYLERVESWYKDGIISPAKRERLLLSHEDYLERKRIGKETDEDKKYWEEFVSRQAGETQYISRESIRILKQCCRNVNATSGSITATLRHLWGYDEVLHQLNFERFKNAGLTETVTWESNHGKNKHSKEQIIDWSKRVDHRHHAIDALVVACTQQGFIQRINTLNADETKDLMKRQIETVGVKYDEKKILLDKYLTSLAPFKTQTVANAASNILVSFKPGKKTATTGKRIEYRNGKKHVVQKGIIIPRGALHEEGVYGEIEINGKKHIVKKYKLGKGAQGFVFTGKETYTEKINKKTGEIQIEDKIKNVLDSIVDGSIRAKVLQRLNQGFEEGKDYRNDVKKALENLNDLDKNPIYADDNNTIPIRTVRCITGLSAIVPIKYNDQGKSIGFVKPGNNHHIAIYQDNEGNLREHSVTFWHAVERKKYGVPVIIDNPIQVWDSIKDRQLPESFLEKLPEVNWTYKISLQQNEMFILGMEDDAYDYAIRNQDYSTLGQYLYKVQNVSEKQYRFSLHNMTKFDIKRMNKADKCFYNIQSIDALFRLHPHKVHISLIGKIKEIQE

SEQ ID NO: 1226 - protein, 1266 aa, unidentified
  REGION 1..1266: note = Description of Unknown:uncultivated organism with predicted taxonomy: Bacteroides
  REGION 1..1266: note = MG16-145 effector
PFTQIFLYFFAIFAKNKKQIIQYTMKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSENEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGAQGFVFTGKETYEEKVNKKTGEIQIEDKIKNVLDSIVDGNIRTKVLQRLNQGFEEGKDYRNDVKKALENLNNLDKNPIYADDNKTIPIHTVRCITGLSAIVPIKYNNQGKPIGFVKPGNNHHIAIYQDEEGNLKEHSVTFWHAVERKKYGIPVIIENPTKLWDEIKDKQLPESFLEKLPEVNWTFKVSLQQNEMFILGMEDDTYDVAMGNKDFTLISKFLYRVQSISESDYWFRLHIESQNDKTPQAKQAKKFHRIKSLKGFYQLHPHKVHISVIGKIKEL

SEQ ID NO: 1227 - protein, 1218 aa, unidentified
  REGION 1..1218: note = Description of Unknown:uncultivated organism with predicted taxonomy: Bacteroidetes
  REGION 1..1218: note = MG16-146 effector
MKKILGLDLGVGSIGWSVIQADEEGNPASLLDIGCRIVPLSTDDANEFSSGNAISKNQMRTQKRTTRKGYDRYQLRRQYLTEELRKLGMLPNERLIKLPVLDLWQLRAYAATPGKKLSLPEIGRVLYHINQKRGYQHSKSDDSDDKSQRDYVQTINNRFATIKTEKKTIGQFFVERLAESEVLTDKGKFYTFRIKEQVFPRKAYVEEFDQIISCQKVYYPDILTDDEIHILRDEIIFYQRPLKSCKHLISRCKFALREYKTADGESIIAGPNVAPRTSPLFQVCKIWESVNNIELKNRDGDSYQFSMEDRQKLFDFLDNNEKLTVTDLKKVLGLNSKDKWWGGKAIGKGLQGNTTKIAIKKALQGHLELLSFNLKSIDSQHIDTQTGEILHEISPDFEKEPLYRLWHIVYSMADPEEMGAAIKRQFGIEDPEILSRLSKIDFVKAGYGNKSARFIRQILPYLQKGLKYSEACDYISINHSNSLTTAENNARKLLSHIPQLQKNELRQPVIEKILNQMVNVVNALIDKHGGIDEVRVELARELKQSKDERNSTFLNNNKRERENKIIEERIAEMGIRPSRSRILKYRLWEEAKHICFYCGQPVGVKEFLEGAEVEIEHIIPRSLFFDDSFANKVCSCRKCNAEKGNRTAFDYMKQKGENEFSDYSRRIEEAFEKKEISKVKRERLLTSAKDIPEDFIDRQLRQSQYISKKAVEMLKQVCRNVWTTSGSVTDFVRHHWGYDNIIHDLNFQRNKNAGQTAIITYEHRGQTHQEERIKEWSKRLDHRHHAIDALTIASTKQSYIQRLNHLNTSRDAMFQELEAQSEEFKEKYSLLERWIKERPHIPVSEVTEAVDGILVSFKAGKRVSTPGKRYTYKKGKRSVAQTGIVVPRGALSEESIYGAISCLEEHVPVKKLFEHPEIIFKSYIREKVENRIREFGGNWKAALQSLKKTPIYLGIDETKPLEYASCWKKEYVIRYPLSSIRKKDVDYIVDQHIRHLVSERIAAVGEKDAFREPLYADKAGKMPIKSVRLFTGLTDSSVSPVKYSHGLPIGFSKPGNNHHYCFYRNRDGELVGHLVSFWHAVERKKYGIPVIIKDTDRLWEEVANRDLPEDFLKNLPPSGLTLEVSLQQNEMFILGMPEEDYQRAIEKSSKNDLNKYLYRVQKISGQYNVFRRNTDTGKEEDSIAQSLGQFIRISSTKGWISYNPHKIHIDILGDICEL

SEQ ID NO: 1228 - protein, 1160 aa, unidentified
  REGION 1..1160: note = Description of Unknown:uncultivated organism with predicted taxonomy: Bacteroidales
  REGION 1..1160: note = MG16-147 effector
MKKKILGLDLGVGSIGWALIETEDNQPKQILGMGSRIVPISKDDNDQFSKGQAITKNADRTARRTARKGYNRYQMRRALLTQALRNNNMLPERMDENVIDLWKLRSDAATEGHQLTLPQIGRVLYHINQKRGYKHSKADENGDSKQTKYVEAVNQRFKDIQEAHQTIGQRFYLELLRTRVHREKGDYYTYRIKDQVFPRAAYIAEFDQIMHVQRVYYPEVLTDEFIDTLRNRIIFYQRPLKSCKHLVSLCEFEMRPYKTKDGKIVYGGPKCAPRTSPLAQLCAMWETANNITLTNRNNERFEFTLEQRRQIVDFLCHNKEMKVTHLQKILGISKKDGWYGGKAIGKGIKGNATLNQLRETLQGKYDQWLEMPIKHVDVVDATTSEVFWAVSPEVEETPLFKLWHAVYSLQNADELAKTLREKFQIFDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSREERESAYRAMGQNERRNKEIAEKISEFGIRPSRSRIQKYKMWEESMHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPADFIERQLRQSQYIAVKAVEVLQDGIRHVWTSGGSVTDFLRHQWGYDEILHTLNLPRYRQVEGLTEYVEFEHAGQKHTEERIKNWSKRIDHRHHAIDALTVALTQQGYIQRLNTLEASHDLMEKQVKEAGTHYNEKKSILEKWINEQPHFSVEDVTNVVKGILVSFRAGKRVTTPARRAIYKGGKRVIAQRGIEVPRGALTKDTIYGKQGESYVVKYPLTHQSMKADNIVDPTIRALVKARLAAYNNNANEAFKTPLYSAEGMEIKSVRCVARLTENGVIPIKYNKQGMAIGYAEKGNNHHVAIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 1229 - protein, 1154 aa, unidentified
  REGION 1..1154: note = Description of Unknown:uncultivated organism with predicted taxonomy: Bacteroidales
  REGION 1..1154: note = MG16-148 effector
MKKKILGLDLGVGSIGWALIETEDNQPKQILGMGSRIVPISKDDGDQFSKGQAITKNADRTARRTARKGYNRYQMRRALLTQALRNNNMLPERMDENVIDLWKLRNDAATEGHQLSLPQIGRVLYHINQKRGYKHSKADENGDSKQTKYVEDVNKRYKDIQEAHQTIGQHFYLELLRSKIERANGPYYTYRIKDQVFPRAAYIAEFDQIMNVQRVYYPEILTDEFIDTLRNRIIFYQRPLKSCKHLVSLCEFEMRPYKAKDGKIVYGGPKCAPRTSPLAQLCAMWETANNITLTNRNNERYEFTLEQRRQIVDFLCHNKEMKVTHLQKILGISKKDGWYGGKAIGKGIKGNATLNQLREALQGKYDQWLEMPIKRIDVVDATTSEVFWAVSPEVEETPLFKLWHAVYSLQNADELTKTLREKFQITDEAVIEALCRIDFVKPGYANKSHKFIRRLLPYLMEGMMYSEACERININHSNSMTREEREQRPLSARIQLLQKNQLRQPVVEKVLNQMINIVNSLKDQYGEIDEARMELARELKQSRDERESAYKAMGQNERRNKEIAAKITEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPSDFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIAQRGIEVPRGALTEETIYGKLGDKFTVKYPLDHPSMKPENIVDSTIRELVQKRVAERGKDAFKEPIYSAEGMKIKSVRCFTSLSENGVVPVKYDEAGRPIGYAKKGNNHHIAIYQDKDGQYQEMVVSFWNAVERKRYGVPVVITNPHEVWDSLLNKDLPQEFLAKLPNDNWQFILSMQENEMFVLGMENDEFNDAIERQDYATLNKHLYRVQKLSTHDYSFRYHTETKVDDKYEGAENGRNASMSLGALVPIRSCGSLFVQFPHKVKVDILGHIHKA

SEQ ID NO: 1230 - protein, 1007 aa, unidentified
  REGION 1..1007: note = Description of Unknown:uncultivated organism with predicted taxonomy: Bacteroidetes
  REGION 1..1007: note = MG16-149 effector
MKRILGLDLGTNSIGWAVVNTDENDKPVSIERMGSRIVPLTSDDTNEFTKGNAITKNQSRTEKRTARKGYDRYQLRREHLTTELRKLKMLPDEKLIKLPVLELWELRGKAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIIECQKEFYPDILTNEEINRLRNEIIFYQRRLKSCKHLVSFCDFEKREYINKVGKVVYGGPKVAPKSSPLFQLCKIWEEVNNLTLRNRKNDELFITIEQRQAMVDFLDTHEKLTLSDMYSILGISKQDGWWGGKAIGRGLQGNTTKIALKKALGDFVNADTLLQFNLKQTDSNLVDEVTGEILQVIDPKLEKEPLYDLWHTIYSISDKEELTNALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFDSIRVELARELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGEIQIEDKIKNVLDSIVDGNIRNKVL

SEQ ID NO: 1231 - protein, 1250 aa, unidentified
  REGION 1..1250: note = Description of Unknown:uncultivated organism with predicted taxonomy: Bacteroidales
  REGION 1..1250: note = MG16-150 effector
MKRILGLDLGTTSVGWALITVDESNNPIDIQDIGVRIVPLAENEGDKFTKGQDITVNADRTLARGIRRNYDRYQMRRRALTEKMRQLNMLPDEHLIKLPVLDLWQLRANAAKQKISLCELGRVLYHLNQRRGYKHARTDSNDSKQKDYVQKINNRYSLLQQLGLTIGQYFAQKLAETAITHNGKTFYVFRIKEQIYPRRAYEEEFDTIMTCQQLFYPTILTDEVINEIRNNIIYYQRDLRSCKHLVSICEFEKRSFYDENGEVKRNKKGEIVYSGPKVAPRTSPLFQVFKNWQSINNLHFHNRRNEDLFITLEQKTHIASIMDNKELLKLKDVHEVLGINNKSGWYCDKAIKAGIKGNTTKTAIIACLSTLPLSIINEIARFNLKTEKTNIVDEESGEIFVRISNNYQDEPLYRLWHIIYSIKDDEERFNAISKFLKDFGIEDDSITNALKDIDFVTPGYANLSAKAISKILPYMMEGLDYSDACEYVGYNHSDSLTKEENASRDLVDKIPLLKKNELRQPTVEKILNQTINIFNQINADLIQKGERIDEVRVELARELKQSKTEREEASAGIRKQQALNDNYANILKSESIRPTRNKILKYRLWTESNKTCFYCDQPVNFKEYLQTTEFEREHVIPKRLIFDDSFANQVCSCSKCNKEKGGLTALDFMRTKANLRNYLDKVDSMYQKHEISGKKRSHLLASYDDYLERKKEGKETKEDIMIWETPIDRQLRLSQYISRKAMEILRMGCREVVATSGSITELIRHTWGYDTILHELNCPDYKEAGLTEIIIDEKTKRQREVISDWTKRLDHRHHAIDALAVACTTHSIVQHINTLHASRKIMRDEIKTSRKEWKDNYLLQQWIKEKMPFDRHYVLHKIASILVSMKAGKKATVPGKRKIYKNGKPQIIQTGIKIPRGQLHEKTIYGAIKQWSGGEEHRKIVTRYKLGIGAAGYVFNGKESCDVIFDKKKKQYVMDDGIDKAIKYIVDKHIQDVIRGRLNEAFPANETYRSEAEKALAEGKTYDGKDRSKKALEQLRTLSEKPLYADKGKTIIIKSVRCFTGLSAVQPLRYNSQNEPIAFVLTKNNHHVAIYSDEKGEYKECVYTFWQAVERSKYRLPLIIKEPHELWREIMKRENDGEHFPDSIIEALPSPNWTFIESLQLNDMFVMDLDDETFEEYITNKNYEKLGKKLYRVQSLSTGDYCFRHHTDTTTDRTNAKLTKKFLRKSLMSFISSNPRKVQISLLGKINRDC

SEQ ID NO: 1232 - protein, 1242 aa, unidentified
  REGION 1..1242: note = Description of Unknown:uncultivated organism with predicted taxonomy: Prevotella
  REGION 1..1242: note = MG16-151 effector
MKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSEIEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGVQGFVFTGKETYEEKVNKKTGEIQIEDKIKNVLDSIVDGNIRTKVLQRLNQGFEEGKDYRNDVKKALGNLNNLDKNPIYADDNKTIPIHTVRCITGLSAIVPIRCNNQGKPIGFVKPGNNHHIAIYQDEEGNLKEHSVTFWHAVERKKYGIPVIIENPTKLWDEIKDKQLPESFMEKLPEVNWTFKVSLQQNEMFILGMEDDTYDVAMGNKDFTLISKFLYRVQSISESDYWFRLHIESQNDKTPQAKQAKKFHRIQSLKGFYQLHPHKVHISVIGKIKEL

SEQ ID NO: 1233 - protein, 1228 aa, unidentified
  REGION 1..1228: note = Description of Unknown:uncultivated organism with predicted taxonomy: Fibrobacter
  REGION 1..1228: note = MG16-152 effector
MKKILGLDLGVGSIGWSVISVDENGDPSEILGMGSRIIPLSTDDANEFSTGNAISKNQKRTQKRTARKGYDRFQLRRENLTAELRKLHMLPDEKLIKLPILELWTLRAKAATEGNKLSLPEIGRILYHINQKRGYKHAKADEAGDKQQTEYVAAVNSRYAMIKERSQTIGQYFAEKIRESEVISEKGKFYTFRTKEQVFPRKAYEEEFDKIIAVQRQYYPDVLTDSAINRLRNEIIFYQRNLKSCKHLVSLCEFEKHEYKNKEGKIVYDGPKVAPRTSPLAQICRIWEFVNNISLENGYKERRELSLEEKQKVVHFLDNNEKMTATDFSKLLGLGKKNEWDLKRYFGQNGVKGNETKVSLRNALKDFPNVEELLQFNLTLDNSNYVNESTGEVLKVISPSFQNEPLYDLWHTVYSLSDKDELSNALGKKFGISDKNAIQQLFKIDFVKPGFSNKSAKAVRRILPFLQQGLMYSEACAEAGYNHSNSLTKTENEARSLLDRLPQIKKNELRQPVVEKILNQMVNVVNAIYDDYGTIDEIRVELARELKQSKDERNTTFNNIAKRERENKGIAERIKNEYGLIPNRNKIEKYRLWEEAEQKCFYCGQTVNVKEFLSGFDVEVEHVIPKSLLFDDSYANKVCACRKCNANKGNKTAFDFMKSQSEDAFNNYVSRVEEYYKNGKISRTKHDRLLTPQSEIPSDFIERQLRQTQYISKKALEMLKEVCRNVYATSGSVTDFIRHTWGYDEILHQLNFDRYKQGGLTEAREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKRVATTGKRIKYEKGQKKVLQEGIVIPRGALSEESVYGKIKVIDPHKPLKFLFENPQTIVSPQIKTAVIDRLSKFGNDVKKAIASIKKEPLTLASDKVINDADCFKEEYVIKYPLEGFKAKDIQFVVDKHIREDVLPKRLAEFDGNEKNAFKDIDKNPIFADANHNIPIKHVRCFTGLSAVVPVKHDDAGKAIGFVKPGNNHHVAIYKDECGKLHESLVSFWNAVERKIKKVPVVITQPQDAWNIAENAHCSEEFTASLPNKTWTFVQSLQVNEMFVLGLEESAYQKAVREKDYNLINKHLYRVQSISKSDYFFRHHLETIIDDTSASKEMKRFYRFKSLGSFFKENPHKVQISVLGKLIVKE

SEQ ID NO: 1234 - protein, 1154 aa, unidentified
  REGION 1..1154: note = Description of Unknown:uncultivated organism with predicted taxonomy: Bacteroidales
  REGION 1..1154: note = MG16-153 effector
MKKHILGLDLGVGSIGWALIETEDDQPKQIIGMGSRIVPISKDDSDQFSKGQAISKNADRTARRTTRKGYDRYQLRRALLTKVLRQNRMLPERMDENVIDLWKLRSDAATEGHQLTLPQIGRVLYHINQKRGYKHAKADDNVDSKQTKYVEAVNQRYAEIQEAKQTVGQHFYLELLRSKVESGNGPYYTFRIKDKVFPRAAYIAEFDQIMKVQKVYYPEVLTDEFIDTLRNRIIFYQRPLKSCKHLVSLCEFEMKPYKTKDGKIVYGGPKCAPRTSPLAQLCAMWETVNNITLTNRNNERYEFSLDERKQLVEHLCTHEALKLTDLYKILGITQKDSWYGGKAIGKGIKGNATLNQLRKALNGKYSEWLEMPIERIDAVDDETAEVFWQVSPKVEETPLFKLWHAVYSIQDADELAKTLRNKFGIDDQEVIDALCKIDFVKPGYANKSHKFIRRLLPYLMDGMMYSEACARIGINHSNSMTAVERDARQLSDHIELLQKNALRQPVIEKILNQMINLVNRLQQEYGPIDEARVELARELKQSREEREGAYRRNNQNERLNKEIIAKIEEMGIRPSRSRIQKYKMWEENNHRCMYCGKTVSLAEFLNGADVEIEHIIPRSILFDDSFSNKVCACRECNHEKGNMTALDYIETKPAAEQEAYKQRVDEAFKEGRISKTKRDHLLWHRSEIPTDFIERQLRQSQYIAVKAVEILQQGIRQVWTSGGSVTDFLRHQWGYDEILHTLNLPRYRQVEDLTEMVHYEHAGQEHDEERIKNWSKRIDHRHHAIDALTVALTRQAYIQRLNTLEASHDFMEKQVKEAGTQYNEKKSILEKWILEQPHFSVDDVTQSVDSILVSFRAGKRVTTPARRAIYQGGKRTIVQTGLQVPRGALTEDHIYGKLGDKFVYKYALTDQSMHPENIVDPTIRAIVQKRVAERGKDAFKEPLYSAEGMEIKSVRCYTSLSENGVVPVKQDEHGRNIGYAKKGNNHHVAIYQDKDGQYQEMVVSFWDAVERKKYGVPVVITNPRAVWDSIMDKDMPQEFLEKLPNDDWTYILSMQENEMFVLGMEEDEYNDAIEAKDYAALNKHLYRIQNISSLFYIFRYHTETKVDDKYEGIANGRNASMSLGALIPIRSFKALFAQFPHKVKIDIMGRITRA

SEQ ID NO: 1235 - protein, 1154 aa, unidentified
  REGION 1..1154: note = Description of Unknown:uncultivated organism with predicted taxonomy: Bacteroidales
  REGION 1..1154: note = MG16-154 effector
MKKKILGLDLGVGSIGWALIETEDNQPKQILGMGSRIVPISKDDNDQFSKGQAITKNADRTARRTTRKGYNRYQMRRALLTQALRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMNVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKHIDVVDAATSEVFWAVNPEVEETPLFKLWHAVYSLQNAEELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEESQHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKRVTTPARRAIYKGGKRVIAQRGIEVPRGALTEETIYGKLGDKFTVKYPLDHPSMKPENIVDPTIRALVQKRVAERGKDAFKEPLYSAEGMEIKSVRCFANVTDNSVVPIKYNEEGQPIGYAKKGNNHHVAIYTDKSGKPQESVVSFWDAVERKRYGVPVVITNPHEVWDNLLNTDFPEEFLAKLPEDDWQYLFSMQENEMFVLEMEDDEFYDAIERQDYASLNKHLYRVQKIRSGEYTFRYHTETKVDDKYEGVANGTNTSFQLGALVSIRGFSSLFAKHPHKVKIDLLGHIHKA

SEQ ID NO: 1236 - protein, 1217 aa, unidentified
  REGION 1..1217: note = Description of Unknown:uncultivated organism with predicted taxonomy: Bacteroidales
  REGION 1..1217: note = MG16-155 effector
MKRILGLDLGVGSIGWSLIQADDEGNPQSILDIGCRIVPLSPDDTNEFSSGNAISKNRKRTQKRTCRKGYDRYQQRRQNLTDELRGLGMLPDERLIKLPVLDLWQLRADAATPGKKLTLPEIGRILYHINQKRGYLHSKTDEDDKAQRDYVQAINNRFAHIKAEGKTIGQYLAGKLADSEVTTDKGQFYTFRIKEQVFPRKAYQEEFDQIIACQRIHYPDILTEEVIHRLSDEIIFYQRPLKSCKHLISQCEFAMREYKTADGKRIQAGPKVAPRSSPLFQVCKIWESVNNIEMKNRNGESYPFSEEERLKLFNFLDNNEKLTVTDLKRILGLSVKDKWWGGKAIGKGLQGNTTKIALKKALQGHEGLLSFHLKTVDSRHIDTETGVILQEIAPGFEKEPLYRLWHIIYSIKEPDEMASALKQQFGIEDPEVLSRLAKIDFVKAGYGNKSARFIRQILPYLQKGLKYSEACDYISINHSNSLTTAENKSRKLQPRMQQLQKNELRQPIIEKILNQMVNVVNALLDKHVSIDEVRVELARELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQLRQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKRLTTPGKRYTYKGGKREIAQSGIIVPRGALSEDSVYGVISCLEENVPVKKLFEHPDIIFKPYIRTKVENRIKEYDGDWKAALKSLKKAPIFLGDGETKPLEYATCWKKEYVIRYPLASIQKKDVKYIVDQHIRQLVSERLNAVGEKDAFKEPLFSDKAEKNPIKSVRLFTGLTHNSLSPVKYLDGFPIGYSKPGNNHHFCYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 1237 - protein, 1154 aa, unidentified
  REGION 1..1154: note = Description of Unknown:uncultivated organism with predicted taxonomy: Bacteroidales
  REGION 1..1154: note = MG16-156 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGPYYTFRIKDKVFPRAAYLDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1238 - protein, 1223 aa, unidentified
  REGION 1..1223: note = Description of Unknown:uncultivated organism with predicted taxonomy: Fibrobacter
  REGION 1..1223: note = MG16-157 effector
MKKILGLDLGVSSIGWSVISVDDNGDPSDILGMGSRIVPLSTDDANEFSTGNAISKNQKRTQKRTARKGYDRYQLRRENLTVELRKHKMLPDEHLIKLPVLKLWTLRASAATEGHQLTLPEIGRVLYHINQKRGYKHAKADEAGDKKQTDYVAAVNQRFAMIKERGQTIGQYFAEKLKENEVVTEKGKFYTYRTKEQVFPRGAYIAEFDQIITVQRKFYPQILTEEFINRLRNEIIFYQRNLKSCKHLVSICEFEKHEYKNKEGKTVFDGPKVAPRTSPLFQICRIWEFVNNIRLENGYKEARELTQEERLKVVEFLDNHEKMTAKDFSKLLKLNKDNEWDLKKYFGKNGIQGNTTKTKLATAIANVPNANDLLRFDLTLENSNFVNEATGEVLKVISSDFQNEPLYMLWHTVYSLSDKDELKSSLEKKYHITDESIVDNLFRIDFIKPGFGNKSAKAIRRILPFLQEGLVYSEACAEAGYNHSNSLTKTENEARTLLARLPQIKRNELRQPVIEKILNQMVNVVNAIYDEYGQIDEIRVELARELKQSKDERKATAANIAKRERENKAIAAKIEEFGIRPSRNRIQKYRLWEESEQKCFYCGQPVDAREFLSGLDVEVEHIIPKSLLFDDSFANKVCACRKCNAAKGNRTAFDYMKSQSSNAFDAYIKRVNDFYKDGKISKTKNERLLTTQSEIPSDFIERQLRQTQYIAKKALEMLKEVCYNVYATSGSVTDFIRHTWGYDEILHQLNFDRYKKGGLTELREFDHKGATHTEERIQNWSKRLDHRHHAIDALVIAMTRQSIIQRLNHLNTERDAMFQEVEKQSKEWKNDYSLLQEWLRERKHFSTDEVAQKVSDILASFKAGKRVATIGKRIKYEQGKKKALQTGIVIPRGPLSEESVYGKIKVLDPSKPIKFLFENPQSIISAEIRTAITNRLSKFENDIKKAIQSLKDDPIILANGKNLETADCYKEEYVIKYSLNGFKAKDIESVVDGHIKEILYKRLEEFNGNEKEAFKDIENKPIFADSAHKIPIRNVRCFTGLSAVVPVKQDNNGNNIGFVKPGNNHHIAIYKDENGNLQESVVTFWHAVERKKYGLPIIITNPAEVWEIAKAKDCPSEFLACLPNEKWSFVQSLQINEMFIMGLDDETYEKTLSEHNYTLINQHLYRVQKLTSNDYFLRFHLETKIDDSAEAKQMGKVLRKSLKTFIQDNPHKVKVSVLGKLIT

SEQ ID NO: 1239 - protein, 1217 aa, unidentified
  REGION 1..1217: note = Description of Unknown:uncultivated organism with predicted taxonomy: Bacteroidetes
  REGION 1..1217: note = MG16-158 effector
MRKILGLDLGVGSIGWSLIETDTKDNPVAILGMGSRIVPLSTDDSNEFSSGNAISKNQKRTQKRTQRKGYDRYQLRRALLTEKMRELGMLSDERLIKLPVLELWQLRANAATPGKQLELKEIGRVLYHINQKRGYKHSRSDDGDEKSQREYVQQVNQRFRDIRDEGLTIGQHFANKLAENEVITPKGKFYTYRIKEQVFPREAYIEEFDRIMDCQQVFYPDILTDTIIREIRNEIIFYQRPLKSCKHLVSVCEFAMREYKTSDGKSILSGPKVAPRSSPLFQVCKIWESVNNLTLKNRSGQVYHFSDEQRQRMFDFLDNHERMTVTDLYKLLNISKKDGWWGGKSIGKGLQGNITKAALAKALSNHRDLLRFQLETIDSKRIDTETGEILKVISSSFEKEPLYSLWHIVYSMHERSEVAAALERQFGITDPDTIDRLFAIDFIKAGYGNKSARFIREILPYLQAGMQYSDACNYIGINHSNSLTTEENANRALLDKLPQLKKNELRQPVIEKILNQMVAVVNALLSRFGPIDEIRVELARELKQSRDERNNAFLNNNKRERENKVLEERIREYGISPSRSRIQKYRLWEESNHLCFYCGQPVGAAEFLSGSGVEIEHIIPRSLLFDDSYANKVCSCRKCNAEKGNSTAYDYMKAKPEGDFEDYLKRIETFFSEKRISKAKRDKLLTPATDIPQDFIDRQLRQSQYISRKAVDMLKLVCRNVWTTSGSVTDFLRHNWGYDQILHDLNLPRYKEGGMTEVVHYEHNGQEHDEERIIGWTKRMDHRHHAIDALTIACTRQSYIQRLNTLNASRDAMHAEIEKQNAYWQEKHSLLEEWTRQRPHLPVSVVRDYVDGILVSFKPGKKVATPGKRYTYNGKKELAQDGLLIPRGALSEESVYGQITSIVEHVPVKRLFEDTSLIFKPYIRNLVEQRIEEYHGDWKKARLSIGKKPIWLDKGETIALEYATCWKKEYVIRYPVSSLREKDVDSIVDRHIREIVQKRIDEVGEKDAFKTPLFYDAAQKIPIKSIRCFTGLDAVEAVKYANGIPIGFSKPGNNHHIAIYRDKEGNRFEHVVSFWHAVERKRFGLPVIIQDTDSVGDQIQGISLPESFLKNLPAPGATLELSLQQNEMFILGMKEDEFNDAIREKDNTALNKHLYRVQKLGSLYYVFRYHTETQIDDSNNAIIMHKFYRCRSLSAFDALNPHKVRVSITGEIMQGDD

SEQ ID NO: 1240 - protein, 971 aa, unidentified
  REGION 1..971: note = Description of Unknown:uncultivated organism with predicted taxonomy: Bacteroidetes
  REGION 1..971: note = MG16-159 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEQILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQLRQSQYIARKSVEMLQQVCKNVYSTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTRITVPGKRYITKNGKRALVQTGIIVPRGALHAEFVYGRIMKQEADGVTLTPQYVRKYKLGIGAQGFLFNGKEFYKEELKRDSKTGLSSIVVTDKIK

SEQ ID NO: 1241 - protein, 1051 aa, unidentified
  REGION 1..1051: note = Description of Unknown:uncultivated organism with predicted taxonomy: Fibrobacter
  REGION 1..1051: note = MG16-160 effector
MKKILGLDLGVSSIGWSVISVDENGDPSEILGMGSRIVPLSTDDANEFSTGNAISKNQKRTQKRTTRKGYDRYQLRRENLTAELRKHQMLPDEHLIKLPVLDLWTLRANAATEGHQLSLPEIGRVLYHINQKRGYKHAKADEAGDKKQTEYVENVNKRFAMIKELGLTIGQFFANKLKESEVISEKGTFYTYRTKEQVFPRGAYIAEFDQIIEVQRKFYPQVLTDEFINRLRNEIIFYQRNLKSCKHLVSLCEFEKHEYKNKDGKIVFDGPKVAPRTSPLFQICRIWEFVNNIRLDGYKETKALSQDERLKVVDFLDNHEKMTAKDFIKLLGLDKNDEWDLKRYFGKNGVQGNSTKTQLAAALANIPNTSELLRFNLALENSNYVNKSTGEVLKVISSDFQNEPLYMLWHTVYSISDKEELKNALNKKYGITDESVINSLFKIDFVKPGFGNKSAKAIRRILPFLQEGLVYSDACAEAGYNHSDSLTKSENEARTLLARLPQIKKNELRKPVIEKILNQMVNVVNAIYDEYGQIDEIRVELARELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQLRQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKRVATIGKRVKYEHEKKFILQTGIVIPRGPLSEESVYGKIKVLDRNKPLKYLFENPQFIANADIKSAVTNRLIQHENDVKKAVLSLKKSPIVLANGKTLETADCYKEEYVIKYSLNGFKAKDIDSVVDTHIKDVLYKRLEEYDGNEKEAFKDIENNPIYADATHKIKIRNVRCFTGLSAVVPVKKDEN

SEQ ID NO: 1242 - protein, 1153 aa, unidentified
  REGION 1..1153: note = Description of Unknown:uncultivated organism with predicted taxonomy: Bacteroidales
  REGION 1..1153: note = MG16-161 effector
MKKNILGLDLGVGSIGWALIETEDDQPKQIIGMGSRIVPISKDDSDQFSKGQAISKNADRTARRTTRKGYDRYQLRRAMLTETLRHNGMLPERMDENVIDLWKLRSDAATEGHQLTLPQIGRVLYHINQKRGYKHAKADDNGDSKQTKYVEAVNQRYVEIQETHQTIGQHFYLELLRSKVESGNGPYYTFRIKDKVFPRAAYIAEFDQIMNVQKAYYPEVLTDELIETLRNRIIFYQRPLKSCKHLVSLCEFEMRPYKTKEGKIVYGGPKCAPRTSPLAQLCAMWEAANNITLTNRNNERYNFSLEERKQIVEHLCSHEALKLTDLYKILGITKKDGWYGGKAIGKGIKGNSTLNQLRKALNGKYGEWLEMPIEHMDVVDEETAEVLWQVSPQVEETPLFKLWHAVYSLQDADELAKTLRNKFNITDQDVIDALCKIDFVKPGYANKSHKFIRRLLPYLIEGMMYSEACARIYINHSNSMTVAERDARPLAEHIELLQKNALRQPVIEKILNQMINLVNRLQQEYGPIDEARVELARELKQSREERENAYKRNNQNERLNKEIAAKIEEMGIRPSRSRIQKYKMWEESDHRCMYCGKMVSLAEFLNGADVEIEHIIPRSILFDDSYSNKVCACRDCNREKDNLTALDYLETKTGAELEAYKQRVDDAFKEGRISKTKRDHLLWRREDIPSDFIERQLRQSQYIAVKAVEILQQGIRKVWTSGGSVTDFLRHQWGYDEVLHTLNLPRYHKVEGMTEFVQYEHAGQTHEEERIKNWTKRVDHRHHAIDALTVALTRQAYIQRLNTLEASHDLMEKQVKDAGTLYNEKKSILEKWINEQPHFSVDEVTRQVDGILISFRAGKRVTTPARRAIYKGGKRIIVQTGLQVPRGALTEETVYGKLGDKFVVKYPLAHPSMKSENIVDPTIRAIVQKRIDERGKEAFKEPLYSAEGMEIKSVRCYTSLSENGVVPVKQDGQGNNIGFAKKGNNHHVAIYQDKNGQYQEMVVSFWDAVERKKYGIPVVITNPHAVWDSVLDKESPQEFLEKLPNDDWKYILSMQENEMFVLGMEDGDFEHAIETQNYAALNKHLYRVQKVSSKFWCFRYHTETMVDDKYGDTKNEQWSFQMGKAFRASSFDGLFRQFPHKVKIDIMGRITKA

SEQ ID NO: 1243 - protein, 1224 aa, unidentified
  REGION 1..1224: note = Description of Unknown:uncultivated organism with predicted taxonomy: Prevotella
  REGION 1..1224: note = MG16-162 effector
MKKVLGLDLGTNSIGWCLIEKSDDNIPQRILRMGSRIVPISSDEESGYTKGNAVSKNAERTHKRTARKCYDRYQLRRQALMSLLKRLGMEPSNELIFEQTPMKIWQTRADAATKKISLPELGRVLLHINQKRGYKHSRLNNFDAKETSYVQEVNSRYDELKAEGLTVGQHFALKLKKNEKTSANGRKYYTYRIKEQVYPRHAYEEEARIILNTQRIFYSDILTEDVCKEFLDTIFYQRDLKSCKNLVSLCEFESYTIKKDGKEITIGPKVCPRTSPLAQLSSILETANNITIRNKRNDELYISPEQRQAIADFLDNNEVMKLTNLYNILHIGKKDGWWAGKAIGKGLKGNTTKMQIRAALSNLPSEQVNMLLKFELEFEDYVDKETGEVRQRVDNTQVEKQPLYRLWHLIYSIKDEDELSNALRRMDIKDEETIRKLCSLDFRSAGYAKKSAKAIGRILPYLMEGMMYSQACEQAGFDHSRRVDPGRTLLSALPQIQKNEFRQPVVEKILQQLVNIINSLISKEGTIDEIRVELARELKQSKDERNEAFKRNNQNEKKNKEYAEHIKEYQLTPTRNRLLKWKLYEESDHACMYCGQPIKVREFLQGADVEREHIIPKGLLFDNSFTNQVCSCRSCNSKKGMRTAYDFIEAEKGEEGLRSYIEHINYLFDKKNISRSKYNRLLVSYKAYLQRKVQGKETEEDKNLWENFIDRQLRQSQYIARKAIEMLQQICKNVYSTSGRVTDFVRHQWGYDEILHDLNFDRYKKAGLTTMVTQLQSGDEVEVERIKDWTKRLDNRHHAVDALAIACTTQGMIQRLNTLNASRDEMQAELNDKNGSIMDPNRSMLEKWVSIQPHITYAEAKNEVDKIIISQRPNTRITVPGKRYIQKNGKRTPVQTGIIVPRGALHAEFVYGRIMKQKPTSDGVVKIPQYVRKYKLGIGAQGYLFNGKEFYKEELKKDPRTGLSTIAVTDKINDVLEKIVDGGIRKRILERLNRGFEDGKDYRSNVPRALANLKNLDDDPIYSDDAKTRPILSVRKEVVSTTMVIVRNDRNGRPLAFAEPDGNHHVAFYKNENGLIEERIVTKWHAVQRKLHHVPIIIDNPSATWSDMLGRTDVPEEILKELPKDNSIFMLSLQIGEAFVMGMEESDYQKAIEEGNKQVLAEHLYFVQNLSSSNYRLRRHVESSYDITGMNKEDQRFLNIKSIGALFNYNPHKVKITVLGDIIP

SEQ ID NO: 1244 - protein, 1261 aa, unidentified
  REGION 1..1261: note = Description of Unknown:uncultivated organism with predicted taxonomy: Bacteroides
  REGION 1..1261: note = MG16-163 effector
FLYFFAIFAKNKKQIIQYTMKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSENEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGAQGFVFTGKETYEEKVNKKTGEIQIEDKIKNVLDSIVDGNIRTKVLQRLNQGFEEGKDYRNDVKKALENLNNLDKNPIYADDNKTIPIHTVRCITGLSAIVPIKYNNQGKPIGFVKPGNNHHIAIYQDEEGNLKEHSVTFWHAVERKKYGIPVIIENPTKLWDEIKDKQLPESFLEKLPEVNWTFKVSLQQNEMFILGMEDDTYDVAMGNKDFTLISKFLYRVQSISESDYWFRLHIESQNDKTPQAKQAKKFHRIKSLKGFYQLHPHKVHISVIGKIKEL

SEQ ID NO: 1245 - protein, 1222 aa, unidentified
  REGION 1..1222: note = Description of Unknown:uncultivated organism with predicted taxonomy: Prevotella
  REGION 1..1222: note = MG16-164 effector
MKKVLGLDLGVGSIGWCLVEKDDKNIPLRIIRMGSRIVPITKEEENGYTRGNAISKNADRTVKRTARKCYDRYQLRRKALVNLLKRCGMMPDKGLILEQSPLDLWQKRADAASKEISLEEVGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDTIFYQRDLKSCKNLVSFCEFESYTIKRNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFNLIFDEYVDEETGELRKRINNSHAEHQPLYRLWHLIYSIKDNDELSIALRSLGIEDEECIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQLRQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLDKIVDGGIRKRILERLNRGFEDGTDYRTNTAKALENLKNLDEDPIYSDDAKTRPIRTVRKYVNSSTMVAVRKDDNGKPVSFVVPDDNHHVAFYKDKDGVITESIVTKWQAVQRKLKHIPVIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 1246 - protein, 1159 aa, unidentified
  REGION 1..1159: note = Description of Unknown:uncultivated organism
  REGION 1..1159: note = MG16-165 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSDAATEGHQLTLPQIGRVLYHMNQKRGYKHAKADDNGDSKQTKYVEAVNQRYAEIKEARQTIGQHFYLELLRSKVESGNGPYYTFRIKDKVFPRAAYIAEFDQIMQVQRAYYPEVLTDELIDTLRNRIIFYQRPLKSCKHLVSLCEFEMKPYKTKDGKIVYGGPKCAPRTSPLAQFCAMWETANNITLTNRNNEQYDFSLEERRQLVEHLCTHEVLKLTDLYKILGITKKDGWYGGKAIGKGIKGNATLNQLRKALNGKYSDWLEMPIERIDAVDNETAEVFWQVSPKVEETPLFKLWHAVYSIQDAEELAKTLRNKFGIDDQDVIEALCKIDFVKPGYANKSHKFIRRLLPYLMEGMMYSEACARIGINHSNSMTAAERDARPLAERIELLQKNALRQPVIEKILNQMINLVNRLQQEYGPIDEARVELARELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPATEVEAYKQRVDEAFKEGQISKTKRDHLLWHRSDIPTDFIDRQLRQSQYIAVKAVEILQQGIRQVWTSGGSVTDFLRHQWGYDEILHTLNLPRYRQVEDLTEIVHYEHAGQEHDEERIKNWSKRIDHRHHAIDALTVALTRQAYIKRLNSLNAEFTREEMLKEVEEANTVYNEKKSLLEKWILEQPHFSVDDVTNSVDSILVSFRAGKRVTTPARRAIYQGGKRTIVQRGLQVPRGALTEETIYGKLGDKFVVKYPLDHPSMKPENIVDPTIRALVQKRVAERGKDAFKEPLFSAEGMEIKSVRCFTSLSENGVVPVKQDEQGRNIGYAKKGNNHHVAIYKDKDGQYQEMVVSFWDAVERKKYGVPVVITNPHDVWDSIMDKDMPQEFLEKLPKDDWSYLLSMQENEMFVLGMEEDEFNDAIEAKDYATLNKHLYRVQKVARNDYWFRYHTETTVDDKYGEGDESKVNLGWSVEMGKVYRVRSCGALFDLFPHKVKIDIMGRITKA

SEQ ID NO: 1247 - protein, 1092 aa, unidentified
  REGION 1..1092: note = Description of Unknown:uncultivated organism with predicted taxonomy: Bacteroidales
  REGION 1..1092: note = MG16-166 effector
MKKVLGLDLGVGSIGWCLIEKEDDNTPKRILRMGTRIVPIGSDEESSYTKGNAFSKNADRTAKRTARKCYDRYQLRRHALVDLLKQLGMEPTHKLIYEQTPLGLWQKRADAASKEITLEELGRVLLHINQKRGYKHSRLDNSKSKETAYVQEVNSRYDQLKDEGLTIGQHFAAKLKENEQTSADGKKYYNYRIKEQVYPRHAYEEEVKKILDVQQQYYADLLTDDVCKEIFNIIFYQRDLKSCKNLVSHCEFESYTITKNGKEITIGPKVAPKTSPLAQLSSILETVNNISIRNRRNDELYISPEQKKALADFLDNNEVMKLTDLYRILNIEKKDGWWAGKAIGKGLKGNTTKCEIRKALGNLTKEQVNSLTAFDLVFEEYVDVETGEVRKRVDNNHAEKQPLYRLWHLIYSIKNEEELKGALRNMGIEDEETLQKLSNLDFRNPGYANKSAKAIGRILPYLMEGMMYSQACEQAGFDHSRRINPERQLLKALPQIQKNELRQPVVEKILQQLVNIVNALLAKEGNIDEIRVELARELKQNREERNEAFKRNAQNEKLNKEYAERIKEYGLTPTRNRIMKMKMWEESENTCMYCGQPVDVVEFLQGADVEREHIIPRGLLFDNSFTNQVCSCRKCNSQKGMRTAYDFIEDEKGQEGLESYIKHINYLFDKKKINRSKLNRLLVSHKAYINRKSLGKETEEDKQLWENFIDRQLRLSQYIAKKSVEMLQQICRNVYVTSGSVTDFVRHQWGYDELLHDLNFERYKKAGLTAMVKQLHSGKEVEVERIKDWTKRLDNRHHAVDALAIACTTQGMIQRLNTLNASRDDMLEELNSKKRVADPNRSMLEKWLYAQPHVSYALAKEELDKIIVSQRPNTRITVPGKRYVTKNGKQTLAQTGIVVPRGALHAEFVYGRIMKQEADGKTLTPQFVRKYKLGIGAQGFLFNGKEFYKEDLKKDAKTGLSTIVVTDKIKEVLDKVVDGGIRRRILDRLNRGFEEGTDYRANVGKALANLKNLDEDPIYSDDAKTRPIRTVRKYVNSSTMVAVRKDKNGRPLSFVEPDGNHHVAFYQDDNGIITESIVTRWQAVQRKLSDIP

SEQ ID NO: 1248 - protein, 1162 aa, unidentified
  REGION 1..1162: note = Description of Unknown:uncultivated organism with predicted taxonomy: Bacteroidales
  REGION 1..1162: note = MG16-167 effector
MKTKILGLDLGVGSIGWALIETEDNQPKQILGMGSRIVPISKDDGDQFSKGQAITKNADRTARRTARKGYNRYQMRRALLTQALRNNNMLPERMDENVIDLWKLRSDAATEGHQLTLPQIGRVLYHINQKRGYKHSKADENGDSKQTKYVEEVNRRYKDIQEAHQTIGQHFYLELLRSKIERANGPYYTYRIKDQVFPRAAYIAEFDQIMNVQRIYYPEVLTDEFIDTLRNRIIFYQRPLKSCKHLVSLCEFEARPYKTKDGKIVYGGPKCAPRTSPLAQLCAIWETANNITLTNRNNERFEFTLEQRRQIVDFLCHNKEMKVSHLQKILGISKKDGWYGGKAIGKGIKGNATLNQLRDALQGKYDQWLEMPIKHIDVVDATTSEVFWAVSPDVEETPLFRLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRSSRSRIQKYKMWEESLHQCFYCGKTIDLSEFLNGADVEIEHIIPRSILFDDSFSNKVCACRRCNQEKGNQTAMEYMETKSASEQEAYKQRVDEAFTTKRISLTKRDHLLWHKADIPSDFIDRQERLSQYIAVKAVDLLQQGIRQVWASSGTVTFFMRHQWGYDEILHTLNLPRYRRVEGMTEFVDFEHAGQKHTEERIKNWSKRIDHRHHAIDALTIALTRQAYIQSLNTLSSEITREEMIEIIKETGKVYKEKTSLLDKWARELPHFSVEDVTNAVDGILVSFRAGKRVTTPARRAIYKGGKRVIAQRGIEVPRGALTKDTIYGKQGESYVVKYPLTHQSMKADNIVDPTIRALVKARLAAYNNNANEAFKTPLYSAEGMEIKSVRCVARLTENGVIPIKYNKQGMAIGYAEKGNNHHVAIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 1249 - protein, 901 aa, unidentified
  REGION 1..901: note = Description of Unknown:uncultivated organism with predicted taxonomy: Barnesiellaviscericola
  REGION 1..901: note = MG16-168 effector
MKNILGLDLGTTSVGWALIKVDDKNNPIDIQDMGVRIVPLAENEGDKFTKGQDITVNADRTRARGQRRNYDRFQLRRQALTEKLRSLNMLPDEHLIKLPIMELWQLRANAVTQKVSLNELGRILYHLNQKRGYKHSRTDAKDSKQRAYVKEINNRYGELIKSGMTIGQFFAKKLSETAVTVEGKTFYVYRIKDQIFPRKAYEEEYDSIMKCQQTFYQEILTNDVIDEIRNRIIYYQRDLRSCKHLVSVCEFEKRCFYDAEGNVKRNKKGEIIYDGPKVVPRTSPLFQIFKNWQSINNLRFHNRKNEYLYITKEQKQQIANIMDIHKVLKLEDVQNVLDITSESGWYCDKAIKAGIKGNTTKHAILSVLSSLPQSKITELTRFNLETEATNLVDEETGEVLVRIKSTYQEEPLYRLWHIIYSIKNEDERFNAISNLLKEFCIEDDSIASALKDLDFVTPGYANLSAKAISKILPYMMEGIDYSESCAYVGYNHSDSITKEENKRRELLDQIPALKKNELRQPTVEKILNQTINIFNQINTNLKKNGERIDEVRIELARELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQLRLSQYISRKAQELLRTACRDVIATSGSITDLIRHTWGYDTILHELNFDCYKKAGLTEFIKDEKTGKNREVIQDWTKRLDHRHHAIDALAVACTSRSIIQRINTLHASREDIRKEIKSTRKEWQENDLLQQWIKEKMPFDRKYVLHKVASILVSMKAGKKATVPGKRKIYK

SEQ ID NO: 1250 - protein, 1154 aa, unidentified
  REGION 1..1154: note = Description of Unknown:uncultivated organism with predicted taxonomy: Bacteroidales
  REGION 1..1154: note = MG16-169 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGSYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKLLDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1251 - protein, 1217 aa, unidentified; identical to SEQ ID NO: 1219
  REGION 1..1217: note = Description of Unknown:uncultivated organism
  REGION 1..1217: note = MG16-170 effector

SEQ ID NO: 1252 - protein, 1153 aa, unidentified; identical to SEQ ID NO: 1242
  REGION 1..1153: note = Description of Unknown:uncultivated organism with predicted taxonomy: Bacteroidales
  REGION 1..1153: note = MG16-171 effector

SEQ ID NO: 1253 - protein, 815 aa, unidentified
  REGION 1..815: note = Description of Unknown:uncultivated organism with predicted taxonomy: Prevotellabrevis
  REGION 1..815: note = MG16-172 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSDAATEGHQLTLPQIGRVLYHMNQKRGYKHAKADDNGDSKQTKYVEAVNQRYTEIQEAKQTVGQHFYLELLRSKVESGNGPYYTFRIKDKVFPRAAYIAEFDQIMKVQKAYHPEVLTDEFIDTLRNRIIFYQRPLKSCKHLVSLCEFEMKPYKNKDGKIVYGGPKCAPRTSPLAQLCTMWETVNNITLTNRNNERYEFSLDERRQLVEHLCTHEVLKLTDLYKILGITKKDGWYGGKAIGKGIKGNATLNQLRKALNGKYSDWLEMPIERIDAVDNETAEVFWQVSPKVEETPLFKLWHAVYSIQDAEELAKTLRNKFGIDDQEVIDALCKIDFVKPGYANKSHKFIRRLLPYLMEGMMYSEACARIGINHSNSMTAAERDARPLAEHIELLQKNALRQPVIEKILNQMINLVNRLQQEYGPIDEARVELARELKQSREEREGAYRRNNQNERLNKEIAAKIEEMGIRPSRSRIQKYKMWEETNHRCMYCGKTVSLAEFLNGADVEIEHIIPRSILFDDSFSNKVCACRECNHEKGNMTALDYIETKPAAEVEAYKQRVDEAFKEGQISKTKRDHLLWHKSDIPTDFIDRQLRQSQYIAVKAVEILQQAIRQVWTSGGSVTDFLRHQWGYDEILHTLNLPRYRQVEDLTEIVHYEHAGQEHEEERIKNWSKRIDHRHHAIDALTVALTRQAYIQRLNSLNAEFTREEMLK

SEQ ID NO: 1254 - protein, 1266 aa, unidentified; identical to SEQ ID NO: 1226
  REGION 1..1266: note = Description of Unknown:uncultivated organism with predicted taxonomy: Bacteroides
  REGION 1..1266: note = MG16-173 effector

SEQ ID NO: 1255 - protein, 1149 aa, unidentified
  REGION 1..1149: note = Description of Unknown:uncultivated organism with predicted taxonomy: Bacteroidetes
  REGION 1..1149: note = MG16-174 effector
MKKKILGLDLGVGSIGWALIETEDNQPKQILGMGSRIVPISKDDNDQFSKGQAITKNADRTQRRTTRKGYNRYQMRRALLTQALRNNNMLPERMDENVIDLWKLRSDAATEGHQLTLSQIGRVLYHMNQKRGYKHSKADDNGDSKQTKYVEEVNQRYKEIQEAHQTIGQHFYLELLRSKIERANGPYYTYRIKDQVFPRAAYMAEFDQIMQTQRVFYPEVLTDEFIDTLRNRIIFYQRPLKSCKHLVSLCEFEARPYKTKEGKIVYGGPKCAPRTSPLAQLCAIWETTNNITLTNRNNEKYEFTLEHRRQIVDFLCHNKEMKVSHLQKILGIGRNDGWYGGKAIGKGIKGNATLNQLRDALQGKYDQWLEMPIKRVDVVDATTGEVFWAVSAEIEETPLFRLWHAVYSLQNAEELAKTLREKFLITDESVIEALCRIDFVKPGYANKSHKFIRRLLPYLMEGMMYSEGCERININHSNSMTREEREQRPLKEHIQLLQKNQLRQPVVEKVLNQMINIVNSLKDQYGEIDEARVELARELKQSRDERESAYKAMGKNERRNKEIAEKIAEFGIRPSRSRIQKYKMWEESMHQCFYCGKTIDLAEFLNGADVEIEHIIPRSILFDDSFSNKVCACRRCNQEKSNQTAMEYMETKPVGELEAYKRRVDEAFTAKRISKTKRDHLLWRKADIPTDFIERQLRQSQYIAVKAVEVLQDGIRQVWTSGGSVTDFLRHQWGYDEILHTLNLPRYRQVEGLTEFVDYEHAGQKHTEERIKNWTKRIDHRHHAIDALTVALTQQGYIQRLNTLEASHDFMEKQVKETGTHYNEKKSILEKWINEQPHFSVEDVTSAVDGILVSFRAGKRVTTPARRAIYKGGKRVIVQRGIEVPRGALTNEFVYTKKGNKYARKYPINAISNPDNIVDETIRQLVKSRLIACGGNTNEAFKTPLYSAEGMEIKTVRCFNNKLSDRGVVAIKYNENNEPIGYAETDNNHHMAIYRQKDGSLKEKIVSFWDAVERKRYGVPVVIANPHEVWDSLLNTEFPQEFLAKLPKDDWQYVLSMQENEMFVLGMEDDEFNDAIERQDYTALNKHLYRVQSISHDDYYFCHHTETKATEKSESLKLGKTLRIRGVNSLKNYFPHKVKVDILGHIHKV

SEQ ID NO: 1256 - protein, 1258 aa, unidentified
  REGION 1..1258: note = Description of Unknown:uncultivated organism with predicted taxonomy: Prevotella
  REGION 1..1258: note = MG16-175 effector
MKNILGLDLGTTSVGWALIKVDDKNNPIDIQDMGVRIVPLAENEGDKFTKGQDITVNADRTRARGQRRNYDRFQLRRQALTEKLRSLNMLPDEHLIKLPIMELWQLRANAVTQKVSLNELGRILYHLNQKRGYKHSRTDAKDSKQRAYVKEINNRYGELIKSGMTIGQFFAKKLSETAVTVEGKTFYVYRIKDQIFPRKAYEEEYDSIMKCQQTFYQEILTNDVIDEIRNRIIYYQRDLRSCKHLVSVCEFEKRCFYDAEGNVKRNKKGEIIYDGPKVVPRTSPLFQIFKNWQSINNLRFHNRKNEYLYITKEQKQQIANIMDIHKVLKLEDVQNVLDITSESGWYCDKAIKAGIKGNTTKHAILSVLSSLPQSKITELTRFNLETEATNLVDEETGEVLVRIKSTYQEEPLYRLWHIIYSIKNEDERFNAISNLLKEFCIEDDSIASALKDLDFVTPGYANLSAKAISKILPYMMEGIDYSESCAYVGYNHSDSITKEENKRRELLDQIPALKKNELRQPTVEKILNQTINIFNQINTNLKKNGERIDEVRIELARELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQLRLSQYISRKAQELLRTACRDVIATSGSITDLIRHTWGYDTILHELNFDCYKKAGLTEFIKDEKTGKIREVIQDWTKRLDHRHHAIDALAVACTSRSIIQRINTLHASREDIRKEIKSTRKEWQENDLLQQWIKEKMPFDRKYVLHKVASILVSMKAGKKATVPGKRKIYKNGKPTIIQSGMRIPRGQLHEQTVYGAITQFSKNNKGKVFQTKEIVTRYKMGVGSMGYVFSGKETCDVINDKKNKSLVIIDGIEKAINYIVDRHIRDVVRNRLNEAFPENETYRSEAEKALAEGKKYDGKERCQKALDQLRKLSEKPLYADKNKNIIIKSARCYTGLSAVQPLRYNNNHEPISYVLTKNNHHVALYKDENGKFQECIYTFWQVVERSKFKLPLIITDTKALWNEIQQRENKGDTFPDSLIQSLPLPNWTFIESLQLNDMFVMDINDDDFEHYIATNNYEELGKKLYRIQNISSFDYSFRLHTDTTSKTTSDAALSKRYIRIKSIKAYIEHNPHKVKISLLGKIIRNTE

SEQ ID NO: 1257 - protein, 1154 aa, unidentified
  REGION 1..1154: note = Description of Unknown:uncultivated organism with predicted taxonomy: Bacteroidales
  REGION 1..1154: note = MG16-176 effector
MKKKILGLDLGVGSIGWALIETEDNQPQKILGMGSRIVPISKDDNDQFSKGQAITKNADRTARRTTRKGYNRYQMRRALLTQALRNNNMLPERMDENVIDLWKLRSDAATEGHQLTLPQIGRVLYHINQKRGYKHSKADKNGDSKQTKYVEAVNQRFKDIQEIHQTIGQHFYLELLRTRVHRENGDYYTYRIKDQVFPRAAYIAEFDQIMNVQRAYYPEVLTDEFIDTLRNCIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVSPEIEETPLFKLWHAVYSLQNADELAKTLREKFQITDEAVIEALCKIDFVKPGYANKSHKFIRRLLPYLMEGMMYSEACKRININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEESLHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKRVTTPARRAIYKGGKRVIAQRGIEVPRGALTEETIYGKLGDKFTVKYPLDHPSMKPENIVDPTIRALVQKRVAERGKDAFKDPLYSAEGMKIKSVRCFANVTDNSVVPIKYNGEGQPIGYAKKGNNHHVAIYTDKSGKPQESVVSFWDAVERKRYGVPVVITNPHEVWDNLLNTDFPQEFLAKLPEDDWQYLFSMQENEMFVLGMEDDEFYDAIERQDYASLNKHLYRVQKIRSGEYTFRYHTETKVDDKYEGVANGTNTSFQLGALVSIRGFSSLFAKHPHKVKVDILGHIHKA

SEQ ID NO: 1258 - protein, 1154 aa, unidentified; identical to SEQ ID NO: 1234
  REGION 1..1154: note = Description of Unknown:uncultivated organism with predicted taxonomy: Bacteroidia
  REGION 1..1154: note = MG16-177 effector

SEQ ID NO: 1259 - protein, 1104 aa, unidentified
  REGION 1..1104: note = Description of Unknown:uncultivated organism with predicted taxonomy: Porphyromonassp. oral taxon 278
  REGION 1..1104: note = MG16-178 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGPYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKALNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTET

SEQ ID NO: 1260 - protein, 1217 aa, unidentified; identical to SEQ ID NO: 1219
  REGION 1..1217: note = Description of Unknown:uncultivated organism
  REGION 1..1217: note = MG16-179 effector

SEQ ID NO: 1261 - protein, 1130 aa, unidentified
  REGION 1..1130: note = Description of Unknown:uncultivated organism with predicted taxonomy: Bacteroidales
  REGION 1..1130: note = MG16-180 effector
MKKKILGLDLGVGSIGWALIETENDQPKQIVGMGSRIVPISKDDNDQFSKGQAISKNADRTARRTTRKGYDRYQLRRALLTQVLRQNGMLPERMDENVIDLWKLRSDAATEGLQLTLPQIGRVLYHINQKRGYKHAKADDNGDSKQTKYVEAVNQRYADLQGEKQTIGQHFYLELLRSKVEGASGPYYTFRIKDKVFPRAAYIAEFDQIMRVQRAYYPEILTEELIDTLRNRIIFYQRPLKSCKHLVSLCEFEMRPYKTKDGKIVYSGPKCAPRTSPLAQLCAMWETANNITLTNRNNERYEFSLEERQQIVEHLCTHDALKLTDLYKILGISKKDGWYGGKAIGKGIKGNVTLNQLRKALNGKYGQWLEMPIEHVDVVDNTTAEVFWAVSPKVEETPLFKLWHAVYSLQDAEELAKTLRNKFGITDQEVIDALCKIDFVKPGYANKSHKFIRRLLPYLMEGMQYSEACTRIGINHSNYMTAAERDARPLAERIELLQKNALRQPVIEKILNQMINLVNRLQQEYGPIDEARVELARELKQSREERENAFKRNNQNERLNKEIADKIEEMGIRPSRSRIQKYKMWEESNHRCMYCGKTVSLAEFLNGADVEIEHIIPRSILFDDSFSNKVCACRECNHEKDNMTALDYLETKPAVEVDAYKQRVDEAFKEGRISKTKRDHLLWHKSDIPQDFIDRQLRQSQYIAVKAVEILQQGIRQVWTSGGSVTDCLRHQWGYDEILHTLNLPRYRQVEDLTEIVHYEHAGQEHDEERIKNWSKRIDHRHHAIDALTVALTRQAYITRLNSLNAEFTREEMLKEVEEANTVYNEKKSLLEKWVNEQPHFSVEDVTQSVDGILVSFRAGKRVTTPARRAIYNGGKRTIVQRGLQVPRGALTNEFVYTKNGNKYARKYPINAISNPENIVDPTIRQLIKARLAAFNGNAKEAFKEPLYSAEGMEIRTVRCYNNKLSDRGVVAMKYNERREPIGYAETDNNHHLAIYRDSKGELQESIVSFYEAVKRKIAGLPIMDEHPEPDWNLVQTMQENEMFVLGMNDEDFEKSIANDDYQLLNKHLYRVQSISHDDYYFCLHTESKATDKNECMKLGSILRIRGVNSLQKYNPHKVKIDIMGRITKA

SEQ ID NO: 1262 - protein, 1154 aa, unidentified; identical to SEQ ID NO: 1237
  REGION 1..1154: note = Description of Unknown:uncultivated organism with predicted taxonomy: Bacteroidales
  REGION 1..1154: note = MG16-181 effector

SEQ ID NO: 1263 - protein, 1219 aa, unidentified
  REGION 1..1219: note = Description of Unknown:uncultivated organism with predicted taxonomy: Prevotella
  REGION 1..1219: note = MG16-182 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEKILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQLRQSQYIARKSVEMLQQICKNVYFTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTRITVPGKRYITKNGKRALVQTGIIVPRGALHAEFVYGRIMKQEADGVTLTPQYVRKYKLGIGAQGFLFNGKEFYKEELKRDSKTGLSSIVVTDKIKDVLEKVVDGGIRHRILERLNRGFEEGADYRANVAQALSNLKNLDEDPIFSDDAKTRPIRTVRKYVSSSTMVAVRKDGNGKPMSFVEPDGNHHVAFYKNEDGTITESIVTKWQAVQRKLNRIPIIIDNPSQTWSEIMGRNDVPEELLQTLPKDKTTFLLSLQIGEAFIMGMDEADFQKAFEEKDMQTLAEHLYFVQSISSSDYRFRRHIEAQYDTNDINKEDKRFLRIRKIQALFEYNPHKAKITVLGD

SEQ ID NO: 1264 - protein, 756 aa, unidentified
  REGION 1..756: note = Description of Unknown:uncultivated organism with predicted taxonomy: Prevotella
  REGION 1..756: note = MG16-183 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEQILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMNRKAQGKETEEDKELWENFIDRHLRLSPYIARKSVEMLQQICKNVYSTSGSVTDFVRHQWGYDEILH

SEQ ID NO: 1265 - protein, 1154 aa, unidentified
  REGION 1..1154: note = Description of Unknown:uncultivated organism with predicted taxonomy: Bacteroidales
  REGION 1..1154: note = MG16-184 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQAKYVEAVNQRYKEIQESKQTIGQHFYLELLRSKVDGVRGPYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKETGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1266 - protein, 930 aa, unidentified
  REGION 1..930: note = Description of Unknown:uncultivated organism with predicted taxonomy: Fibrobacter
  REGION 1..930: note = MG16-185 effector
MKKILGLDLGVSSIGWSVISVDKNGDPSEILGMGSRIVPLSTDDANEFSTGNAISKNQKRTQKRTARKGYDRYQLRRENLTAELRKHQMLPDERLIKLPVLDLWTLRANAATEGCKLSLPEIGRVLYHINQKRGYKHAKADEAGDKKQTEYIENVNKRFAMIKELGLTIGQFFANKLKESEVVSEKGTFYTYRTKEQVFPRGAYIAEFDQIIEVQRKFYPQVFTDEFINRLRNEIIFYQRNLKSCKHLVSLCEFEKREYKNKDGKIVFDGPKVAPRTSPLFQICRIWEFVNNIRLDGYKETKALSQDERLKVVDFLDNHEKMTAKDFIKLLGLDKNDEWDLKRYFGKNGVQGNSTKTQLAAALANIPNTSELLRFNLALENSNYVNKSTGEVLKVISSDFQNEPLYMLWHTVYSISDKEELKNALNKKYGITDESVINSLFKIDFVKPGFGNKSAKAIRRILPFLQEGLVYSDACAEAGYNHSDSLTKSENEARTLLARLPQIKKNELRQPVIEKILNQMVNVVNAIYDEYGQIDEIRVELARELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQLRQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKRVATIGKRVKYEHEKKFILQTGIVIPRGPLSEESVYGKIKVLDRNKPLKYLFENPQSIVNTDIKSA

SEQ ID NO: 1267 - protein, 1222 aa, unidentified
  REGION 1..1222: note = Description of Unknown:uncultivated organism with predicted taxonomy: Prevotella
  REGION 1..1222: note = MG16-186 effector
MKKVLGLDLGVGSIGWCLVEKDDKNIPLRIIRMGSRIVPITKEEENGYTRGNAISKNADRTVKRTARKCYDRYQLRRKALVNLLKRCGMMPDKGLILEQSPLDLWQKRADAASKEISLEEVGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDTIFYQRDLKSCKNLVSFCEFESYTIKRNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFNLIFDEYVDEETGELRKRINNSHAEHQPLYRLWHLIYSIKDNDELSIALRSLGIEDEVCIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQLRQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLDKIVDGGIRKRILERLNRGFEDGTDYRTNTAKALENLKNLDEDPIYSDDAKTRPIRTVRKYVNSSTMVAVRKDDNGKPVSFVVPDDNHHVAFYKDKDGVITESIVTKWQAVQRKLNHIPIIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 1268 - protein, 1155 aa, unidentified
  REGION 1..1155: note = Description of Unknown:uncultivated organism with predicted taxonomy: Bacteroidales
  REGION 1..1155: note = MG16-187 effector
MKKKILGLDLGVGSIGWALIETEDNQPQKILGMGSRIVPISKDDNDQFSKGQAITKNADRTARRTTRKGYNRYQMRRALLTQVLRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMSVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVNPDVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYRAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQLRQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIVQRGIEVPRGALTEETIYGKLGDKFTVKYPLDHPSMKPENIVDPTIRALVQKRVAERGKDAFKEPLYSAEGMKIKSVRCYTSLSENGVVPVKYDEAGKPIGYAKKGNNHHIAIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 1269 - protein, 1222 aa, unidentified
  REGION 1..1222: note = Description of Unknown:uncultivated organism
  REGION 1..1222: note = MG16-188 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMLEQTPMELWQKRADAASKEISLEELGRVLLHINQKRGYKHSRLSNSDSKETAYVQEVNSRYDDLKAEELTVGQHFAAKLKENEQISADGKKYYNYRIKEQVYPRHAYEEETKKILEVQSRYHSDVLTPDVCKEMMDIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCQIREALSAHPKEQVDSLIAFQLEFDEYVDEETGEVSKRINNTLAEQQPLYKLWHMLYSIKDNRELSGALQHLGIEDNESIEKLCNLDFRTAGYANKSAKAIGRILPYLMEGVMYSEACERAGLDHSRRIDPNRPLLKHLPQIQKNELRQPVVEKILNQLVNIVNALLEKEGAIDEIRVELARELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQLRQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYITKNGKRTLVQTGIIVPRGALHAEFVYGRIMKQKTDGVTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAVRKDDNGKPVAFVEPDGNHHVAFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 1270 - protein, 1222 aa, unidentified
  REGION 1..1222: note = Description of Unknown:uncultivated organism
  REGION 1..1222: note = MG16-189 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMLEQTPMELWQKRADAASKEISLEELGRGLLHINQKRGYKHSRLSNSDSKETAYVQEVNSRYDDLKAEELTVGQHFAAKLKENEQISADGKKYYNYRIKEQVYPRHAYEEETKKILEVQSRYHSDVLTPDVCKEMMDIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCQIREALSAHPKEQVDSLIAFQLEFDEYVDEETGEVSKRINNTLAEQQPLYKLWHMLYSIKDNRELSGALQHLGIEDNESIEKLCNLDFRTAGYANKSAKAIGRILPYLMEGVMYREACERAGLDHSRRIDPNRPLLKHLPQIQKNELRQPVVEKILNQLVNIVNALLEKEGAIDEIRVELARELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQLRQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYITKNGKRTLVQTGIIVPRGALHAEFVYGRIMKQKTDGVTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAVRKDDNGKPVAFVEPDGNHHVAFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 1271 - protein, 1224 aa, unidentified
  REGION 1..1224: note = Description of Unknown:uncultivated organism with predicted taxonomy: Prevotellaruminicola
  REGION 1..1224: note = MG16-190 effector
MKKVLGLDLGVGSIGWCLIEKDDNNTPRRILRMGSRIVPISSDEESGYTRGNAISKNADRTAKRTARKCYDRYQLRRQALVNLLKILGMEPNKNLMFEQTPLELWQKRADAASKEITLEELGRVLLHINQKRGYKHSRLSNSDSKETAYVQEVNSRYVVLRAEGLTVGQHFAAKLKENEQESTDGKKYYNYRIKEQVYPRHAYEEEVKKILEVQSQYHSDVLTSDVCKEIGDIIFYQRDLKSCKNLVSFCEFESYTIKKDGKKITIGPKVAPRTSPLAQLSSILETANNITIRNRRNDELYISPEQRKAIAEFLDNHEVMKLTDLYKILNIGKKDGWWAGKAIGKGLKGNTTKCQIREALSGLPKEQVDSLTAFKLEIDEYVDEETGEVRKRIDNTKAEKQPLYRLWHLLYSIKDNDELTGALRHLGIENKEIIEKLCKIDSRTAGYANKSAKAIGRILPYLMDGVMYSEACGRAGYDHSRRVNPDRVLLTHLPQIQKNELRQPVVEKILNQLVNIVNALLEKEGAIDEIRVELARELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMSRKAQGKETDEDKELWENFIDRQLRQSQYIAKKSVEMLQQVCKNVYTTSGSVTDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTRITVPGKRYVIKSGKRTLAQTGIIVPRGALHAEFVYGRIQKQEADGDTKTYQYVRKYKLGIGAQGFLFNGKEFYKEELKKDSKTGLSSIVVTDKIKDVLDKIVDGGIRQRILERLNRGFEEGADYRANVARALENLKNLDEDPIYSDDAKTRPIRTVRKYVSSSTMVAVRKDSNGKAISFVEPDGNHHVAFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 1272 - protein, 1155 aa, unidentified
  REGION 1..1155: note = Description of Unknown:uncultivated organism with predicted taxonomy: Labilibaculumfiliforme
  REGION 1..1155: note = MG16-191 effector
MKKKILGLDLGVGSIGWALIETEDNQPQKILGMGSRIVPISKDDNDQFSKGQAITKNADRTARRTTRKGYNRYQMRRALLTQVLRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMSVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVNPDVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQLRQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIVQRGIEVPRGALTEETIYGKLGDKFTVKYPLDHPSMKPENIVDPTIRALVQKRVAERGKDAFKEPLYSAEGMKIKSVRCYTSLSENGVVPVKYDEAGKPIGYAKKGNNHHIAIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 1273 - protein, 1222 aa, unidentified
  REGION 1..1222: note = Description of Unknown:uncultivated organism with predicted taxonomy: Bacteroidales
  REGION 1..1222: note = MG16-192 effector
MKKVLGLDLGVGSIGWCLIEKDDNNTPKRILRMGSRIVPISSDEETGYTKGNAISKNADRTVKRTARKCYDRYQLRRKALVNLLKRLGMEPNENLMFEQTPIELWQKRADAASKEVSLEELGRVLLHINQKRGYKHSRISNSDIKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIDENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSKIVVTDKIKDVLDKIVDGDIRQRILERLNRGFEEGVDYRVNVAKALANFKNLDDDPVYSDDAMTRPIRTVRKYVSSSTMVAIRMDSNGRPIAFVEPDDNHHVAFYKDEDDEKKEIVVTKLLAVQRKLNHIPIIIDNPSQTWSEVLGRNDVPEELLQSLPKDKSIFLLSLQKGEAIIMGLEEMDYQRAILAKDMRTLCNHLFYVQSASSRDYRFRRHVEVKYDTKDINKDDMRFLRIRTINELFKINPHKVKVTVLGDIIE

SEQ ID NO: 1274 - protein, 1226 aa, unidentified
  REGION 1..1226: note = Description of Unknown:uncultivated organism
  REGION 1..1226: note = MG16-193 effector
MKKILGLDLGVGSIGWSVISVDENGDPSEILGMGSRIVPLSTDDANEFSTGNAISKNQKRTQKRTARKGYDRYQLRRENLTAELRKHQMLPDEHLIKLPVLDLWTLRANAATEGFKLSLPEIGRVLYHINQKRGYKHAKADEAGDKKQTEYVENVNKRFAMIKDLGLTIGQFFASKLKESEVVSEKGKFYTYRTKEQVFPRGAYIAEFDQIIEVQRKFYPQVFTDEFINRLRNEIIFYQRNLKSCKHLVSLCEFEKHEYKNKDGKIVFDGPKVAPRTSPLFQICRIWEFVNNIRLENGYKEARTLSQDERLKVVDFLDNHEKMTAKDFTKLLELNKNDEWDLKRYFGKNGTQGNTTKTQLATALANIPNASELLQFNLTLENSNYVNEKTGEVLKVVSSDFQNEPLYMLWHTVYSLSDKEGLKNTLNKKYGITEESVINNLFKIDFVKPGFGNKSAKAIRRILPFLREGLVYSDACVEAGYNHSDSLTKSENEARTLLSRLPQIKKNELRQPVIEKILNQMVNIVNAIYDEYGQIDEIRVELARELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQLRQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKRVATIGKRVKYEHGKKIVLQTGITIPRGPLCEESVYGKIKVLDRNKPLKYLLENPQYIVNADIKFAITNRLAQYENDVKKAVQSLKKSPVVLANGKKLENADCYKEEFVIKYSLNGFKAKDIDSVVDNRIRNVLYKRLEEYNGNEKEAFKDIENNPIYADATHKIKIRNVRCFTGLSAVVPVKKDENGNAIGFVKPGNNHHVAIYKDENGNLQESVVTFWHAVERKKYGLPIVITNPIDAWKLAREQNCPKEFLDSLPNENWIYEQSLQENEMFVMGLDDNMYDKAVAEKNYALLNQHLYRVQKISSSDYYFRYHLETKLDDSASAIEIGKYKRIRSFKAFALAKPHKVKISLLGKLITRV

SEQ ID NO: 1275 - protein, 760 aa, unidentified
  REGION 1..760: note = Description of Unknown:uncultivated organism with predicted taxonomy:Sediminibacterium sp. C3
  REGION 1..760: note = MG16-194 effector
MKKVLGLDLGVGSIGWCLVEKDDNNTPTRILRMGSRIVPISSDEETGYTKGNAISKNADRTAKRTARKCYDRYQLRRKALQEMLKRLGIEPNKKLMLEQAPLELWQKRADAVSTKIALEDLGRVLLHINQKRGYKHSRLNNSDSKETAYVQEVNNRYDELKAEGLTVGQHFAAKLKDNEQTSADGKKYYNYRIKEQVFPRHAYEEEAKKILETQSRYYPDLLTPDVCKEIMNIIFYQRDLKSCKNLISYCEFESYTITKDGKEITIGPKVAPRTSPLAQLSSILESANNITIRNRKNDELYISPEQRKALADFLDNHEVMKVSDLYGILNIGRKDGWWAGKAIGKGLKGNTTKCQLREALKNLPQEKINALTSFNLEYDEYVDEETGEVRKRVNNHLAERQPLYRLWHLIYSIKDSDELAAALRRFGIDDEESILNLCNLDFRTPGYANKSAKAIGRILPYLAEGVMYSDACNMAGFDHTRRLNPNRPLLTSLPQIQKNELRQPVVEKILQQVVNIVNTLIEKEQSIDEIRVELARELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWDNFIDRQLRLSQYIAKKSVEMLQQVCRNVYSTSGSVTDFVRHQWGYDELLHDLNF

SEQ ID NO: 1276 - protein, 1248 aa, unidentified
  REGION 1..1248: note = Description of Unknown:uncultivated organism with predicted taxonomy: Bacteroides
  REGION 1..1248: note = MG16-195 effector
KMKNILGLDLGTTSIGWALIKTDNNNIPCEIRGMGVRRVPLAENEGDKFAQGQSVTINADRTKARGIRRNNDRYKLRRQALSEKLSSLGIEPNDSLMKLHMMDLWQLRANAATDRVSLPELGRILHHLNKKRGYKHSSKDEDKSMRDFLKNVRERYSELHCLNMTLGQFFAKKLLETAVTKGDKTYYVFRIKDLVFPRKAYEEEYDTIMQCQKKFYPNVLTDEVIDYIRNHIIYYQREPRSCKHLVSVCEFEKRHFYDKEGQLKRNNRNEIIYDGPKVAPRTSPIFQLYITCQSANNIRFHNKKKDYLYITREQRQRIVHFMDTNEKLKLADVKRILEINDKSEWYCDNAIKNGIKGNTTKCAIVNALSSLPQEKIAEITRFHLETEPTKDVDTETGEVLVKIKNNYQHEPLYRLWHIIYSIKKEEERTHAVTKFLQSFGVDNDDIVQKLSNIDFTTPGYGNISAKAICRILPYMMEGIEYSEACEYVGINHSNSLSKEENERRELMCQLPAIKKNSLRQPTVEKILNQTINVFNRINAELSQTGECINEVRVELARELKQSKDERHDTSEVIKALENKNKEYKTFIEKEYKLKATRKNLLRYRLWIESNQSCFYCLKPIKFTPFANESEEEREHILPKALHYDDSFANQVCSCKDCNSTKGGRTAMDYMRTTPYLQHYIDRVNKLYQANKISGKKYSHLLASYDDYQLRKKEGKETKEDILIWEKPIDRQLRLSQYISKKAMEILSFGCRDVVATSGSITAIIRHAWGWDTILEELNIQTYRNANLTEVIEVKSKGQNKKMETIKNWTKRLDNRHHAIDALVVACTSSSIIQRINTLNASKQKMRDEITSARKKWDENNILTQWIREKNPLNRKEVLEHVSSIFISMKAGKKVTVPGKRKEFKHGKAMIKQEGLRIPRGPLHEEGLYGSILIEGKKEIVIRYKLGKGTIGYLFTGKEKCEVKKNGNEYTLKDGIAAILDSIVDKHIRNLVENRLNRIFPDGETYRSEAEKALKEGREYNGEKRCKEALEQLKGLDDDPLFHDKDETRIIKSIRCKTGLNAVRPIRFNDNNEAITYVLPKNNHHVAIYRDENGKFIECVCTFWDAVGRVNQNIPCIISNIEEVWNDIHRREANGEYFSVEFKNTLPKEDWTFVESMQQNEMFVMDMDRETLERNIASGNYSVISQHLYRVQALSAGDYIFRIHTDTKSERTKEANLSKRFIRLSLKKFVASEHQKVQLSILGGITIAQ

SEQ ID NO: 1277 - protein, 891 aa, unidentified
  REGION 1..891: note = Description of Unknown:uncultivated organism with predicted taxonomy:Gammaproteobacteria bacterium
  REGION 1..891: note = MG16-196 effector
MKKVLGLDLGVGSIGWCLIEKDDNNTPKRILRMGSRIVPISSDEETGYTKGNAISKNADRTAKRTARKCYDRYQLRRKALVNLLKRLGMEPNENLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIDENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNSQNERENKEYAERIKEYGLTPTRNRIMKMRMWEESEYTCMYCGQPVNVVEFLKGADVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKR

SEQ ID NO: 1278 - protein, 1250 aa, unidentified
  REGION 1..1250: note = Description of Unknown:uncultivated organism with predicted taxonomy: Bacteroides
  REGION 1..1250: note = MG16-197 effector
MKNILGLDLGTTSVGWALIKAEDNNTPVEIQGMGVRIVPLAENEGDKFTRGQDVTVNADRTTARGIRRNYDRYQLRRQALTEKLRQLNMLPDENLIKLPVLELWQLRANAAKEKVTLSELGRVLYHLNQKRGYKHSQADKKDSKQRAYVKEINSRYTELNSLGMTIGQFFAQKLEETAVTHDGKTLFVYRIKDQIYPRQAYEEEYDIIMKCQQGFYPDILTDEVIDEIKNRIIYYQRDLRSCKHLVSICEFEKRCFYDAEGNVKRNEKGEIIYDGPKVAPRTSPLFQIFKNWQSINNIRFHNRRNEYLFISKEQRQVIAGVMDNAETLKLKDVQSVLGLTSKSGWYCDKAMKSGIKGNTTKCAILSALSSLPDSTIKDITRFNLETEETKNVDEETGEILLRIKNTYLDEPLYRLWHIIYSIKNVDERFNAIAKFLKEFNVEDASVVNALNDIDFVTPGYANLSSKAMCKMLPYLMDGLDYSDSCEYVGYNHSGSLTKEENANRELLNQIPALKKGELRQPTVEKILNQTINVFNQLSARLEKRGERIDEVRVELARELKQSKDERKEASDGIRKQQKRNEEYAKMLVEEGVRPTRNRILRYRLWEESNKRCFYCGQPISFNEFIKSSDAEREHVIPKALMFDDSFANQVCSCRECNKEKGGRTALDYMRTKSNLQAYLDRVDDMYQSHQIGGKKHSHLLASYDDYLSRKKEGKETKEDIMIWETPIERQLRLSQYISKKAQEILKTACREVVATSGTITDLIRHTWGYDTILHELNFPNYKEAGLTSFVTDEKTNQQREVIKDWSKRLDHRHHAVDALAVACTSRSIVQHINTLHASRDEMRKEVNSARKDWKDNNLLQQWIMEKKPFDRQYVLHKVASILVSMKAGKRTTVPGKRKVYKNGKPITIQTGLRIPRGQLHEQTIYGAIKQYDKDGKETTKIVTRYKVEDIFKGKETCDVVLDKKTNQYYINDEIEKALSYVVDKHIRDVIKERLNEAFPDGETYRSEAEKALVEGKPYKGENRCKQAFEQLKTLDEHPLYADKNKSIVIKKVRCYTGLSAVQPLRYNNNNDPISYVLTKNNHHVAIYADENGKYKECIYTFWQAVERSKYRLPLIIKDPKALWDEITQRENNGENFPDSLIKSLPMRDWTFIESLQSNDMFVMDMDDNDFEICISTNNYEELGKHIYRIQSISTLDYFFRLHTDTTSTTTPEAALSKRFIRIKSFKSYIAHNPHKIQVSLLGKIFTNQND

SEQ ID NO: 1279 - protein, 818 aa, unidentified
  REGION 1..818: note = Description of Unknown:uncultivated organism with predicted taxonomy: Bacteroidales
  REGION 1..818: note = MG16-198 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMFEQTPIELWQKRADAASKEVSLEELGRVLLHINQKRGYKHSRISNSDIKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIYENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYINRKALGKETDEDKELWENFIDRQLRQSQYIAKKSVDMLQQVCKNVYTTSGSVTDFVRHQWGYDELLHELNFERFKKAGLTAMVKQLHSGKEIEVERIKDWTKRLDNRHHAVDALAIACTTQGMIQRLNT

SEQ ID NO: 1280 - protein, 988 aa, unidentified
  REGION 1..988: note = Description of Unknown:uncultivated organism with predicted taxonomy:Gammaproteobacteria bacterium
  REGION 1..988: note = MG16-199 effector
MKKVLGLDLGVGSIGWCLIEKDDNNTPKRILRMGSRIVPISSDEETGYTKGNAISKNADRTAKRTARKCYDRYQLRRKALVSLLKRLGMEPNENLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQLREALSGLPKEQVDSLTAFNLEIYENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVDMLQQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSKIVVTDKIKDVLDKIVDGDIRQRILE

SEQ ID NO: 1281 - protein, 1233 aa, unidentified
  REGION 1..1233: note = Description of Unknown:uncultivated organism with predicted taxonomy: Fibrobacter
  REGION 1..1233: note = MG16-200 effector
MKKILGLDLGVGSIGWSVISVDENGDPSEILGMGSRIVPLSTDDANEFSTGNAISKNQKRTQKRTTRKGYDRYQLRRENLTAELRKHQMLPDEHLIKLPVLDLWTLRANAATEGQKLSLPEIGRVLYHINQKRGYKHAKADEAGEKKQTEYVENVNKRFAMIKDLGLTIGQFFARKLKESEVVSEKGKFYTYRTKEQVFPRGAYIAEFDQIIEVQRKFYPQVFTDEFINRLRNEIIFYQRNLKSCKHLVSLCEFEKHEYTNKDGKIVFDGPKVAPRTSPLFQICRIWEFVNNIRLENGYKEARTLSQDERLKVVDFLDNHEKMTAKDFTKLLGLNKNDEWDLKRYFGKNGTQGNTSKTQLATALANVPNASELLQFNLTLENSNYVNEKTGEVLKVVSSDFQNEPLYMLWHTVYSLSDKEELKNALNKKYGITDESVINNLFKIDFVKPGFGNKSAKAIRRILPFLQEGLVYSDACAEAGYNHSDSLTKSENEARTLLARLPQIKKNELRQPVIEKILNQMVNVVNAIYDEYGQIDEIRVELARELKQSKDERNTTASNIAKKERENKNIEAKIQEFGIRSSRNRIQKYRLWEESEQKCFYCGQPVQAKEFLSGLDVEVEHIIPKSLLFDDSFANKVCACRKCNADKGNKTAYDFMKGQKTEVFDAYVKRVNDFYKDGKISKTKKERLLTTQSEIPSDFIERQLRQTQYIAKKALEMLKDVCYNVYATSGSVTDFIRHTWGYDEILHQLNFDRYKKGGLTELREYDHKGETHTEERIQDWSKRLDHRHHAIDALVIAMTRQSIIQRLNHLNTERDAMFQEVEKQSKEWKNDYSMLQEWLRERKHFSTEDVAKKVSDILVSFKAGKRVATIGKRVKYEHGKKKVLQTGVVIPRGPLSEESVYGKIKVLDRNKPLKYLFENPQSIANADIKFAVTNRLAQYEHDVKKAVQSLKKSPIVLANGKNLENADCYKEEYVIKYSLNGFKAKDIDSVVDSHIKDVLYKRLEEYDGNEKEAFKDIEDNPIYADDAHKIKIRNVRCFTGLSAVVPVKKDENGNAISFVKPGNNHHVAIYKDENGTLQESVVTFWHAVERKKYGLPIIVTKPAEAWKLAIEKNCPKEFLDCLPKENWTFVESLQVNEMFVIGMNDEEFGNAIVDKDYALLNQHLYRVQKITTKEYCFRLHTETKVDDKYKGVKDAMKSKAMGKLKMIQSMDSWQKANPHKVKISLLGKLITRE

SEQ ID NO: 1282 - protein, 1242 aa, unidentified
  REGION 1..1242: note = Description of Unknown:uncultivated organism with predicted taxonomy: Prevotella
  REGION 1..1242: note = MG16-201 effector
MKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAKIKERNQTIGQFFAEKLKENEIETSKGKFYTYRIKEQVFPRKAYEAEFDQIMECQKEFYPDILTNEEINRLRNEIIFYQRRLKSCKHLVSFCDFEKREYINKVGKVVYGGPKVAPKSSPLFQICKIWEEVNNLTLKNRKNDELFITIDQRQAMVDFLDTHEKLTLSDMYSILGISKKDGWWGGKAIGRGLQGNTTKIALKKALGDFANADNLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFASIRVELARELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGGIQIEDKIKNVLDSIVDSNIRAKVLQRLNQGFEEGQDYRNNVKKALDNLNNLDENPIFADKNNTIPIRTVRCRTGLSAVVPIKKDERGEAIGFVKPGNNHHIAIYRDKEGKLKEHAVTFWHAVERKKYGIPVVIENPLEVWDSIRDKQLPETFLEKLPDINWTFEMSLQQNEMFVLGMEDDTFENAMRDKEYDLISNYLYRVQSISESDYWFRLHLETQNDKTTSAKLAKKYYRTKSIKGFYSLNPHKVYISVIGKIKEL

SEQ ID NO: 1283 - protein, 1155 aa, unidentified
  REGION 1..1155: note = Description of Unknown:uncultivated organism
  REGION 1..1155: note = MG16-202 effector
MNKKILGLDLGVGSIGWALIKTEDDMPKEIIGMGSRIVPLSKDDNDQFSKGQAITKNADRTARRTARKGYDRYQLRRALLTQVLRQNGMLPERMDEQVLDLWQLRSDAATEGCQLTLPQIGRVLYHINQKRGYKHAKSDDNGDSKQTKYVEAVNNRYADLQAAHQTIGQHFYEELYRSRVEREKGFYYTYRIKDQVFPRAAYIAEFDQIMHVQKAFYPDVLTDELIDTLRNRIIFYQRPLKSCKHLVSLCEFEMRPYKTKDGKVVYGGPKCAPRTSPLAQLCAMWETANNITLTNRNNEQLLISPEQRKQIVDFLCSHDVLKLTDLYKILGINKKDGWYGGKAIGKGIKGNATLNQLRAALNGKHAEWLEMPIEIEDKVDEVTGEVVKMVQSSVEQTPLFQLWHAVYSLQNADELAKTLREKFGIAEQEIINALCKIDFVKPGYANKSHKFIRRILPYLMDGYMYSEACEKVGIRHSNSMTVAERNTRSLRARIELLTKNSLRQPVVEKILNQMINLVNRLQQEYGTIDEARVELARELKQSRDERESAYKAMGQNERRNKEIAAKIAEFGIRPSRSRIQKYKMWEESQHRCFYCGEMMDLTQFLNGADVEIEHIIPRSILFDDSYSNKVCACRRCNQEKGNMTAMEYMEAKPSAEFEAYKQRVDDVFNKDHRISKTKRDHLLWRRADIPQDFIDRQLRQSQYIAKKAVEILKDGIREVWTSGGSVTDFLRHQWGYDEILHTLNLPRYQQVEGLTETIQYEHAGQTHEEERIKNWTKRIDHRHHAIDALTVALTQQAYIQRLNTLEASHDHMQKVVNEAGTQYNEKKSLLEKWVAEQPHFSVADVTDKVDGILVSFRAGKRVTTPARRAIYQGGKRTIVQTGIQVPRGALTEETVYGKLGDKFIVKYPLDHPSMKPENIVDPTIRALVQRRVAEKGKEAFNEPLCSAEGMKIKSVRCFTSLSEKGVVPVKHNEAGEPIGYAKKGNNHHIAIYQDKKGEYHEMVVSFWDAVERKKYGVPVVIEHPHELWDSLLDKELPQEFLAKLPLDDWQFILSMQENEMFVLGMEEDEFNDAIERQEYNTLNKHLYRVQKISHADYTFRYHTETKVDDKYEGIEKGRDTSLKLGALVSIRSFGSLFTKFPHKVKIDIMGRITRT

SEQ ID NO: 1284 - protein, 1003 aa, unidentified
  REGION 1..1003: note = Description of Unknown:uncultivated organism with predicted taxonomy: Bacteroides sp.CAG:144
  REGION 1..1003: note = MG16-203 effector
MKNILGLDLGTTSVGWALIQADDNNHPIAISDMGVRIVPLAENEGDKFTKGQDITVNADRTRARGIRRNYDRFQLRRNALTEKLRQLNMLPDEHLIKLPVLELWSLRANAVSQKVTLNELGRVLYHINQKRGYKHSRTDGTDSKQRAYVKDINDRYAELKNSGKTIGQLFAQKLSETAVSHDGKTFYVFRIKDQIFPRKAYEEEYDAVMKCQQQYYPQILTNEVIDEIRNRIIFYQRELRSCKHLVSVCEFEKRCFYDANHNVLRNNKGEVVYSGPKVAPRTSPLFQVFKNWQAVNNIRFHNRRNEYLYITKEQKQQMVNIMDHQEVLKLKDVHGVLGLSAKSGWYCDKSIKSGIKGNTTKLAILNALSSLPAENTKELTRFHLEFEETSLVDEETGEIIVQIKNNYLDEPLYRLWHIIYSIKDDAERYNAIVRFLAEFHVDAPDVAHSLKDIDFVTPGYANLSAKAICKILPYMMEGVGYSEACEFVGYNHSGSVTKAENDARELLEHIPAIKKNELRQPTVEKILNQMINVFNRINDNLKSNGERIDEVRIELARELKQSKEERDETSKGISKQQKLNDEYANLLKESGIRPTRNKITRYRLWREANETCFYCGQPVNFNEFVKFSEAEREHIIPKSLILDDSFANQVCSCRKCNAEKGGRTAIDYMRTTPYLQAYLTKVDEMFQGHKISGKKHAHLLASYEDYLVRKQQGKETKEDVNIWEAPIDRQLRLSQYITKKAHELLRTACRDVLATSGSITDLTRHVWGYDTILHELNLPRYKSAGITEVITDERTGREQEVIRDWNKRLDHRHHAIDALAVACTSRSMIQRINTLHASREEMREEVSSPRKDWKENDLLRQWIKEQRPFERQYVLHKVESILVSMKAGKKATVPGKRKVFKNGKPVVVQSGLRIPRGQLHEQTVYGAITLYDKTPEGRREIVARYKMGVGSVGFVFSGKESCDVVFDKKKEQYVLVDGIEKAINYIVDRHIRDIVRERLNEAF

SEQ ID NO: 1285 - protein, 1222 aa, unidentified
  REGION 1..1222: note = Description of Unknown:uncultivated organism with predicted taxonomy: Bacteroidales
  REGION 1..1222: note = MG16-204 effector
MKKVLGLDLGVGSIGWCLIEKDDNNTPKRILRMGSRIVPISSDEESGYTKGNAISKNADRTAKRTARKCYDRYQLRRQALVNLLKRLGMEPSKNLMLEQTPMELWQKRADAASKEISLEELGRVFLHINQKRGYKHSRLSNSDSKETAYVQEVNSRYDDLKAEGLTVGQHFAAKLKENEQETADGKKYYNYRIKEQVYPRHAYEEEVKKILEVQSRYHSDVLTPDVCKEILDIIFYQRDLKSCKNLVSLCEFESYTITKDGKEITIGPKVAPRTSPLAQLSSILETANNITIRNRRNDELYISPEQRRAIAEFLDNHEVMKLTDLYKMLNIGRKDGWWAGKAIGKGLKGNTTKCQIREALSALPKEQVDSLTAFQLEFDEYVDEETGEVRKRINNTLAEQQPLYKLWHMLYSIKDNDELSGALRHLGIEDEESIDKLCKCDFRTAGYANKSAKAIGRILPYLMEGVMYSDACERAGFDHSRRINSDRTLLTHLPQIQKNELRQPVVEKILNQLVNIVNALLEKEGAIDEIRVELARELKQSKDERNEAFRRNNQNERLNKELAERIKKYGLTPTRNRIMKLKMWEESEHSCMYCKQPVDPVEFLKGADVEREHIIPRALLFDNSFTNQVCSCRRCNSKKGMRTAYDFIADEKGQEGLNAYIEHINDLFDKKKISRSKLNRLLVSHKAYISRKAQGKETDEDKELWENFIDRQLRQSQYIAKKSVEMLQLVCKNVYTTSGSVTDFVRHQWGYDELLHELNFERFKKAGLTAMVKQMHSGKEIEVERIKDWTKRLDNRHHAVDALAIACTTQGMIQRLNTLNASREEMLEELSINDQRLIDPERSMLEKWLFVQPHISYAEAKNEINKIVISQRPNTRITVPGKRYVIKNGKRTLAQTGIIVPRGALHAEFVYGQIMKQEADGVTKTLQYVRKYKLGIGAQGFLFNGKEFYKEELKKDSKTGLSSIVVTDKIKDVLEKIVDGGIRQRILERLNRGFEEGADYRANVAQALANLKNLDEDPIYSDDAKTRPIRTVRKYVSSSTMVAVRKDGNGKPMSFVEPDGNHHVAFYKDENGVITESIVTKWLAVQRKLNHIPIIIDNPSQTWCEVLERNDVPEELLQSLPKDNSTFLLSLQIGEAFIMGMEDADYQKALLAKDVRTLCDHLFYVQNASSHDYRFRRHVEAKYDTNDMNKDDMRFLRIRTIDDLFNNNPHKVKVTVLGVIVE

SEQ ID NO: 1286 - protein, 1233 aa, unidentified; identical to SEQ ID NO: 1281
  REGION 1..1233: note = Description of Unknown:uncultivated organism with predicted taxonomy: Fibrobacter
  REGION 1..1233: note = MG16-205 effector

SEQ ID NO: 1287 - protein, 1011 aa, unidentified
  REGION 1..1011: note = Description of Unknown:uncultivated organism with predicted taxonomy:Gammaproteobacteria bacterium
  REGION 1..1011: note = MG16-206 effector
MKKVLGLDLGVGSIGWCLIEKDDNNTPKRILRMGSRIVPISSDEETGYTKGNAISKNADRTVKRTARKCYDRYQLRRKALVNLLKRLGMEPNKNLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFHLEIDEYVDEETGEVRKRINNTQAEQQPLYKLWHMLYSIKDNNELAGALNHLGIEDEESIEKLCKLDFRTVGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILQQVCKDVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSIIVVTDKIKDVLDKIVDGDIRQRILERLNRGFEEGVDYRANVPQALANL

SEQ ID NO: 1288 - protein, 957 aa, unidentified
  REGION 1..957: note = Description of Unknown:uncultivated organism
  REGION 1..957: note = MG16-207 effector
MKNILGLDLGTTSVGWALIQSDDNNHPITISDMGVRIVPLAENEGDKFTKGQDITVNADRTRARGIRRNYDRFQLRRNALTEKLRQLNMLPDEHLIKLPVLELWSLRANAVSQKVTLNELGRVLYHINQKRGYKHSRTDGTDSKQRAYVKDINDRYAELKSSGMTIGQLFAQKLSETAVSHDGKTLYVFRIKDQIFPRKAYEEEYDAVMKCQQQYYPQILTNEVIDEIRNRIIFYQRELRSCKHLVSVCEFEKRCFYDANHNVLRNNKGEVVYSGPKVAPRTSPLFQVFKNWQAVNNIRFHNRRNESLYITKEQKQQMVDIMDRQEVLKLKDVHEVLGLTAKSGWYCDKSIKSGIKGNTTKLAILNALSPLPAEKTKELTRFHLEFEETSLVDEETGEIIVRIKNNYLDEPLYRLWHIIYSIKDDAERYNAIVRFLAEFHVDAPEVANSLKDIDFVTPGYANLSAKAICKILPYMMEGVGYSDACEFVGYNHSGSMTKAENDARELLEHIPAIKKNELRQPTVEKILNQMINVFNRINDNLKSNGERIDEVRIELARELKQSKEERDETSKGISKQQKLNDEYANLLKGKGIRPTRNKITRYRLLMESNETCFYCGQPVNFNEFVKFSEAEREHIIPKSLILDDSFANQVCSCRKCNAEKGGRTAIDYMRTTPHLQAFLSKVDEMFQGHKISGKKHAHLLASYEDYLVRKKQGKETKEDVNIWETPIDRQLRLSQYITKKAHELLRTACRDVLATSGSITDLTRHVWGYDTILHELNLPRYKSAGITEVITDERTGREQEVIKDWNKRLDHRHHAIDALAVACTSRSMIQRINTLHASREEMREEVSSPRRDWKENDLLRQWIKEQLPFERQYVLHKVESILVSMKAGKKATVPGKRKVFKNGKPVVVQSGLRIPRGQLHEQTVYGAITLYDKAPEGRREIVARYKMGVGSVGFVFL

SEQ ID NO: 1289 - protein, 1234 aa, unidentified
  REGION 1..1234: note = Description of Unknown:uncultivated organism
  REGION 1..1234: note = MG16-208 effector
MYLCSRKTNKTLYNMKKVLGLDLGVSSIGWALITKDNNNQPIDILKIGSRTVPLLDGEEEGFSNGNGISANSSRTQKRTARKCNNRYKLRREKLTDGLRALNMLPNAMLFNLNPLELWQLRAKAVTDKVSLPELGRILFHLNQKRGYKHSKDNEQDSKQTEYVATINKRYIDLQEKGLTIGQYFAQKLKESEKIQENGVCYTYRIKDQVYPRAAYEEECHKILLNQQRFYPEVLTDDVIKDFFNFIYYQRPLKSCKHLVSRCELEKQLLSSDDDVANYAPKVAPLSSPLAQLDKIWEAVNNFTIRDKRNDELFITLEQRKEIVNYLQEHLTINRSKMREILGISKTKRWFIKADNLRVLQGNKTRIKIAEALSKGDLSQEEINGYLRFDLGYDCQVDTQTGEIAATIIKATFEEQPLYQLWHYIYSIPEERDLKNKLMKFGIHDETVLDALCGISFKTIGYAKKSTRAIRKILPYLAEGFKYSEACYLAGYNHSNSITKDEEANRKLKEYIPQIQKNELRQPVVEKILNQMINIVNSLLKDGPINEIRVELARELKQSKDEREKTSKDIRANKKKNDECAERVKEYGFSPTRNRIMRYKMWVETNHRCIYCNDGVNVKDFLSGVDVEREHIIPKALLFDDSFSNQTCSCRKCNRDKGSRTALDYIRDCGREEEYITRVNELLEKRQISKTKYNHLLTSYRDYLERKTQGKETQEDKDLWEHFIDRQLRQSQMIARKSFEVLRQICHNVYATSGSVTDFLRHQWGYDNILHDLNFERFSKSDNIEEITIVGRDGIETKVKRIKGWNKRIDNRHHAVDALTIALTTQSMIQRLNTLYASRDAMHGDIEASKQKFNEKKSILEKWTAIQPHFTYSQASEAISRILISQRGGKRITTPGKRYEFKGGKKILKQTGIVVPRTALHDEFIYGQISRYDAKGLLTKEIVRKYGIFGGMGCLFTGKETYKEETVSDKKTGISTIKISDGIKDVLDKIVDGGVRKRILERLNRGFEEGKDYRSDTKKALDNLRHLDEDPIFLDDARTIPIKTVRKFTHSTKAIPLRYNDSHQPIAFVEPGGNHHVALYKAPDGTIKEHICTNWHAVQRRLFGLPAIIDKPSEIWVKALENDKFPEDLLSHLPEENLNFIVSLQIGDAFILGMEEEEYQQAISNNNYKLLSEKMYYIQNLSSLNYRFRRHVEAQFDTHQMNKEDLRFYNIKSIGAFFNLNPHRVNVSLIGEIIV

SEQ ID NO: 1290 - protein, 911 aa, unidentified
  REGION 1..911: note = Description of Unknown:uncultivated organism with predicted taxonomy:Chryseobacterium vrystaatense
  REGION 1..911: note = MG16-209 effector
NLTIMKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIMECQKEFYPDILTNEEINRLRNEIIFYQRRLKSCKHLVSFCDFEKREYINKVGKVVYGGPKVAPKSSPLFQICKIWEEVNNLTLKNRKNDELFITIEQRQAMVDFLDTHEKLTLNDMYSILGISKKDGWWGGKAIGRGLQGNTTKIALKKALGDIANADNLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFASIRVELARELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKKT

SEQ ID NO: 1291 - protein, 1152 aa, unidentified
  REGION 1..1152: note = Description of Unknown:uncultivated organism
  REGION 1..1152: note = MG16-210 effector
MKKILGLDLGVASIGWALIEADEQNAPKSILAMGSRIVPLSTDDATEFSQGKAISKNRNRTQKRTQRKGYDRYQMRRAALTEELRAHHMLPDEILIKLPVLELWQLRADAATRQLTLPEIGRVLYHINQKRGYRHAKSDSDEEKAQRDYVQAVNDRYAELKAEGKTIGQHFADKLKENCIITEKGPFYTYRIKEQVYPRAAYMEEFDLVIACQKEFYPEVFTDAFINRLRNEIIFYQRSLKSCKHLINQCEFSQRAYKKADGSIVIAGPKVAPRTSPLFQICKIWESVNNLKLTNRKGEEYPFTLSQRKELVEFLDEHEKLTLTDLYKIIGVKKNDGWWGGKAIGKGLQGNTTKCLIKKALGDKYADLLRFDLHIIESKNIDTETGEVLEIISPGLEKEPLFRLWHILYSMQDKDEMAAALHRQFGITEEDIIDALYKIDFVKPGYGNKSSRFMREILPYLQKGMMYSDACNYIGINHSNSITSEENAVRELKSRLPQLQKNELRQPVIEKVLNQMVNVVNALLDKYGEIDEIRVELARELKQSKDERNEVFLRNNKRERENAEIIKRIEEYGVRPSRSRIQKYRLWEESNQICFYCGNTVGVKEFLSGVDAEIEHIIPRSLFFDDSFSNKVCACRACNQEKGNRTAYDYMQSKSEIEFDNYLRRVENYYNEKKISKTKRERLLTAAKDIPQDFLDRQLRQSQYISKKAIEMLKQICRYVWATSGSVTDFIRHNWGYDKILHDLNFERYKSGGLTEMVHYDHQGQEHDEERIKEWTKRLDHRHHALDALTIASTQQGYIQRLNHLNTERDQMFAELEMQREEYKGRYSLLEEWIKERPHISVEDAKVAVDQIAVSFKAGKKVATPGKRYIYKSGKRILAQDGILVPRGALSEESVYGSISTIERNVPAKNLFEHPERIFKGYIRKLVEERIAECGGDWKKARASINKRPIFLDDEGQKKLEYATCWKEESVFHYPIKSIKKNDVDWIVDGHIREIIRKRIEEVGEKNAFNEPIYADKACNIPIRHVRMFTGLSAVEPIKYVDGQPVGFVKPGNNHHIAIYVDTQGNKVEQAVTFWHALERKKYGFPVIIDDTDTVWEKVDQMDLPEAFIKNLPEPGLKLYTSLQQNEMFILGMGEDEYNDAVAAKDYKSLCK

SEQ ID NO: 1292 - protein, 1242 aa, unidentified
  REGION 1..1242: note = Description of Unknown:uncultivated organism with predicted taxonomy: Prevotella
  REGION 1..1242: note = MG16-211 effector
MKKILGLDLGTNSIGWAVVNTDDNGIPTHIEGMGSRIVPLSPDDTNEFTKGNAITKNQSRTEKRTARKRYDRYQLRRENLTAELRKLKMLPDEKLIKLSVLELWELRGKAASKGNQLTLSEIGRILYHINQKRGYKHAKSDENADTKQKAYVAEVNARYAMIKERNQTIGQFFAEKLKENEIETPKGKFYTYRIKDQVFPRKAYEAEFDQIMECQKEFYPEILTEKVINKLRNEIIFYQRKLKSCKHLVSICDFEKQEYINKDGKSIYRGPKVAPKSSPLFQICKIWEEVNNLSLKNRKNDELFITLEQRQAMVNFLETHEKLTLSDMYSILGISKQDGWWGGKAIGKGLKGNVTKIALKNALGDFENADRLLQFNLKQIDSNLVDEVTGEILQVIDPKMEKEPLYDLWHTIYSISDKEELANALKKKYNIHDEDVINRLYSIDFVKSGFGNKSSKAMRRILPYLQQGLKYSDACEYAGFRHSDSLTKAENDARQLLEKLPPIQKNTLRQPIVEKILNQMINVVNALMIEYGQFDSIRVELARELKQSKDERNTTFLQNEAMQRLNESIAKRLSFEDIKPTKRTIEKYKFIFPTKGCIDKRTGKFVTKSFDGLSTINQCIYCGQPFSLSAALNGDGYEIEHIIPRDLLCDNSQNNKVLSCRKCNSRKSNKTAFDFMRSQDESIFEEYLERIELWYKNGIISPTKREHLLLSHEDYLERKKKGKVTDIDKKYWEDFVSRQVGETQYISRESIRILKQCCRTVNATSGKITAILRHLWGYDEILHQLNFERYKKAGLTETKTWESNHGKNKHSKEQIVDWSKRIDHRHHAIDALVVACTQQGVIQRINTLNADETKDLMKKQIESANIKYEEKKVLLDKYLTSLVPFNTKTVAEAVNKILVSFKAGKKTATVGKRIEYKHGKKHIVQKGIIIPRGALHEEGVYGKIEINGKKEIVKKYKLGKGAQGFVFTGKETYAEKVNKKTGAIQIEDKIKDVLDSIVDGNIRAKILQRLNRGFVEGEDYRNNVKQALDNLNNLDENPIFADDNNNIPIRTVRCRTGLSAVEIIKRNEGGEAIGFVKPGNNHHIAIYRDKEGKLKEHAVTFWHAVERKKYGIPVVIENPLEVWDSIRDKQLPETFLEKLPDINWTFEMSLQQNEMFVLGMEDDTFENAMRDNDYAKLGQYIYKVQNISEKQYRFSLHTATKFDVKRMNKTDKSFYNIRSLDALFALHPHKVYISVIGKIKEL

SEQ ID NO: 1293 - protein, 1224 aa, unidentified; identical to SEQ ID NO: 1243
  REGION 1..1224: note = Description of Unknown:uncultivated organism with predicted taxonomy: Prevotellaihumii
  REGION 1..1224: note = MG16-212 effector

SEQ ID NO: 1294 - protein, 1217 aa, unidentified
  REGION 1..1217: note = Description of Unknown:uncultivated organism with predicted taxonomy: Treponema pedis
  REGION 1..1217: note = MG16-213 effector
MKKILGLDLGVASVGWALIEADEQNAPKSILAMGSRIVPLSTDDATEFSQGKAISKNRNRTQKRTQRKGYDRYQMRRAALTEELRANDMLPDETLIKLPVLELWQLRADAVTRQLTLPEIGRVLYHINQKRGYRHAKSDSEEEKSQRDYVQAINDRYAELKAEGKTIGQHFADKLKENCIITEKGPFYTYRIKEQVYPRAAYMEEFDRVISCQKGFYPTVFTDAFINRLRNEIIFYQRNLKSCKHLINQCEFSQRAYKKADGSIVIAGPKVAPRTSPLFQICKIWECVNNLRLTNRKGEEYPFTLEQRKELVDFLDNHEKLTLSDLYKILGIRKSDGWYGGKAIGKGLQGNTTKCLIKKALGDKYADLLRFDLQTIGSKSIDTETGEVLEIISPELEKEPLFRLWHILYSMQDKDEMAAALQRQFGITEGDIIDALYKIDFVKPGYGNKSSRFMREILPYLQKGMMYSDACNYIGINHSNSVTSEENAVRELKSRLPQLQKNELRQPVIEKVLNQMVNVVNALLDKYGEIDEIRVELARELKQSKDERNEVFLRNNKRERENAEITKRIEEYGIRPSRSRIQKYRLWEESNHICFYCGQPVGAKEFLSGVDVEIEHIIPRSLFFDDSFSNKVCACRKCNQDKGNSTAFDFMKAKPEVEFDNYLRRVESYYNEKRISKTKRDRLLTAAKDIPEDFINRQLRQSQYISKKAVEMLKQVCRYVWTTSGSVTDFLRQTWGYNNILHDLNFERYKSGGLTEIRQYDHKGQEQSKECIIGWTKRLDHRHHALDALTIASTQQGYIQRLNHLNTERDEMFAELKKQSEEHKEKHSLLEDWMKERPHLSVEAVKEAVDQIAVSFKAGKKVATPGKRYIYKGGKRVLAQDDILVPRGALSEESVYGSISTIERNVPAKNLFEHPERIFKGYIRKLVEERIAEYGGDWKKARASLNKRPIFLDDKGQRKLEYATCWKEEMVLRYPIEKIDKGKVDKIVDSHILDIIRKRIEEAGEKNAFKEPIYADEACTIPIRHVRLFTGLTAVEPIKYADGQPVGFVKPGNNHHIAFYVDAQGNKSEHVVTFWHALERKKYGFPIIIEDTDAVWEKVDQMDLPEAFVRNLPEPGLKLDMSLQQNEMFILGMGEDTYRDAMAAKDYKTLCKHLYRVQNIANLDYYFRLHIDTSDDKSNEAQKIKKFYRVRSISSLMDLNPKKVKISILGEIFPLDD

SEQ ID NO: 1295 - protein, 1224 aa, unidentified
  REGION 1..1224: note = Description of Unknown:uncultivated organism with predicted taxonomy:Sediminibacterium sp. C3
  REGION 1..1224: note = MG16-214 effector
MKKVLGLDLGVGSIGWCLLEKDDKNVPIRIIRMGSRIVPISTDEETGFTKGNAISKNADRTAKRTARKCYDRYQLRRQALVNLLRRLGMEPSKNLMLEQTPMELWQKRADAASKEISLVELGRVLLHINQKRGYKHSRLSNSDSKETAYVQEVNSRYDDLKAEGLTVGQHFAAKLKENEQLSAAGKKYYNYRIKEQVYPRCAYEEEVKKILEVQSQYHSDVLTADACKEMMDIIFYQRDLKSCKNLVSLCEFESYTITKNGKEITIGPKVAPRTSPLAQLSSILETANNITIRNKRNDELYISPEQRKAIADFLDTHEVLKLSDLYKILNIGRKDGWWAGKAIGKGLKGNTTKCQIRKALSKLPKDLVDSLTAFQLEFEECVDQETGEVRKRINNTLVEKQPLYHLWHLIYSIKDVDELSGALRHLGIEDEESIRNLCDLDFRTAGYANKSAKAIGRILPYLMEGVMYSEACERAGFDHSRRIDPNRTLLKHLPPIQKNELRQPVVEKILNQLVNIINALIEKEGAIDEIRVELARELKQSKDERNETFKRNNQNERQNKEYAERIKEYGLTPTRNRIMKMKMWEESEYTCMYCGQPVNVTEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWIVVQPHISYSEAKNEIDKIVISQRPNTRMTVPGKRYVTKNGKRTLAQTGIVVPRGALHAEFVYGRIMKQEPDGITMTPQYVRKYKLGIGAQGFLFNGKEFYKEELKKDSKTGLSKIVVTDKIKEVLDKIVDGGIRQRILERLNRGFEEGADYRANVAQALTNLKNLDEDPIYSDDAKTRPIRTVRKYVSSSTMVAVRKDDKGKPVAFVEPDGNHHVAFYKNENGVISETIVTKWQAVQRKVNHIPIIIDNPSQTWSKVLGRNNVPEELLQSLPRDSSSFLLSLQIGEAFIMGMEEAEFQKALEEKDMQTLAEHLYFVQNISSNNYRMRRHVESSFDTTDMNKEDQRFFNIQSISSFFNSNPHKVKITILGDIVVDV

SEQ ID NO: 1296 - protein, 1222 aa, unidentified
  REGION 1..1222: note = Description of Unknown:uncultivated organism with predicted taxonomy: Prevotella
  REGION 1..1222: note = MG16-215 effector
MKKVLGLDLGVGSIGWCLIEKDDNNTPKRIIRMGSRIVPISSDEETGYTKGNAISKNADRTAKRTARKCYDRYQLRRQALVNLLKQLGMGPSKNLMLEQTPIELWQKRADAASKEITLEELGRVLLHINQKRGYKHSRLSNSDSKETAYVQEVNSRYDDLKAEGLTIGQHFAAKLKENEQESADGKRYYNYRIKEQVYPRHAYEEEAKRILEVQSRYHSDVLTSDVCKEMMDIIFYQRDLKSCKNLVSLCEFESYTITKDGKEITIGPKVAPRTSPLAQLSSILETANNITIRNRKNDELYISPEQRKAIADFLDNHEVMKLTDLYKILKIGRKDGWWAGKAIGKGLKGNTTKCQIREALSALPKEQVDSLTAFQLEIDEYVDEETGEVRKRINNTKAEKQPLYRLWHLLYSIKDVDELSGALHNLGIEDEESIEKLCNLDFRTAGYANKSAKAIGRILPYLMEGVMYSDACERAGFDHSRRINPDRVLLTHLPQIQKNELRQPVVEKILNQLVNIVNALLEKEGTIDEIRVELARELKQSRDERNETFKRNNQNERQNKVYAERIKEYGLTPTRNRIMKMKMWEESEYTCMYCGQPVNVTEFLKGADVEREHIIPRGLLFDNSFTNQVCSCRRCNSKKGMRTAYDFIADDKGQDGLNAYIDRINNLFDKKKISRSKLNRLLVSHKAYISRKAQGKETDEDKELWENFIDRQLRQSQYIAKKSVEMLQQVCKNVYTTSGSVTDFVRHQWGYDDLLHDLNFERFKKAGLTAMVKQLHSGKEVEMERIKDWTKRLDNRHHAVDALAIACTTQGMIQRLNTLNASRDEILEELNSKDQRVVDPERSMLEKWVYAQPHISYAEAKNEIDKIVISQRPNTRITVPGKRYVTKNGKRTLAQTGIIVPRGALHAEFVYGRIMKQEADGVTMTPQYVRKYKLGIGTQGFLFKGDEVYKEELKKDSKTGLSKIVVTDKIMDVLEKIVDGGIRQRILERLNRGFEEGTDYRANVAQALANLKNLDEDPIYSDDAKTRPIRTVRKYVSSSTMVAVRKDSNGKPISFVEPDDNHHVAFYMYQDGERTESVVTKWQAVQRKLNHIPIIIDNPSQTWNEVLGRNDVPDELLQSLPQDKSIFLLSLQKGEAVVMGLEEMNYQRALEKKDMRTLCNHLFYVQSASSHDYRFRRHVEAKYDTKDMNKDDMRFLRIRTVDELFKNNPHKVKVTVLGDIVE

SEQ ID NO: 1297 - protein, 1222 aa, unidentified
  REGION 1..1222: note = Description of Unknown:uncultivated organism with predicted taxonomy: Bacteroidales
  REGION 1..1222: note = MG16-216 effector
MKKVLGLDLGVGSIGWCLIEKDDDNTPKRIIRMGSRIVPISSDEETGYTKGNAISKNADRTAKRTARKCYDRYQLRRQALVNLIKRLYMLPNKELMLEQTPLEIWQKRADAASKEITLEALGRVLLHINQKRGYKHSRLSNADRKETAYVQEVNSRYDELKAEGLTIGQHFAAKLKENEQTSNDGKKYYNYRIKEQVYPRHAYEEEVKKILEIQSQFHADVLTPDVCREIMDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1298 - protein, 917 aa, unidentified
  REGION 1..917: note = Description of Unknown:uncultivated organism with predicted taxonomy: Porphyromonascatoniae
  REGION 1..917: note = MG16-217 effector
MKKVLGLDLGVGSIGWCLIEKDDNNTPKRILRMGSRIVPISSDEETGYTKGNAISKNADRTTKRTARKCYDRYQLRRQALVNLLKKLGMEPSKNLMLEQTPMELWQKRADAASKEVSLDELGRVLLHINQKRGYKHSRLSNSDSKETAYVQEVNSRYKDLKAEGLTIGQHFAAKLKENEQETADGKKYYNYRIKEQVYPRHAYEEEVKKILEVQSQYHSDLLTSDVCKEIADIIFYQRDLKSCKNLVSFCEFESYAITKDGKEITIGPKVAPRTSPLAQLSSILETANNITIRNRKNDELYISPEQRKAIADFLDNHEVMKLTDLYKILNIGKKDGWWAGKAIGKGLKGNTTKCQIREALANLPKEQVDSLTVFQLDIDNYVDEETGEVRQRINNTKAEKQPLYRLWHLLYSIKDVDELSGALRHLGIEDEESIEKLSKLDFRTAGYANKSAKAIGRILPYLMEGMMYSDACERAGFDHSRRINPDRALLTYLPQIQKNELRQPVVEKILNQLVNIVNALLDKEGAIDEIRIELARELKQSKDERNEAFKRNNQNERQNKEYAERIKVYGLTPTRNRIMKMKMWEESEYTCMYCGQPVNVTEFLQGADVEREHIIPRGLLFDNSFTNQVCSCRRCNSKKGMRTAYDFIADDKGQEGLDAYIDRINDLFNKKKISRSKLNRLLVSHKAYIIRKTQGKETEEDKELWENFIDRQLRQSQYIAKKSVEMLQQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYVAKNGKRTLAQTGIIVPRGALHAEFVYGRIMKQ

SEQ ID NO: 1299 - protein, 1224 aa, unidentified
  REGION 1..1224: note = Description of Unknown:uncultivated organism with predicted taxonomy: Prevotella
  REGION 1..1224: note = MG16-218 effector
MKKVLGLDLGVGSIGWCLIEKDDNNTPRRILRMGSRIVPISSDEESGYTRGNAISKNADRTAKRTARKCYDRYQLRRQALVNLLKKLGMEPNKNLMFEQTPLELWQKRADAASKEITLEELGRVLLHINQKRGYKHSRLSNSDSKETAYVQEVNSRYVVLRAEGLTVGQHFAAKLKENEQESADGKKYYNYRIKEQVYPRHAYEEEVKKILEVQSQYHSDVLTSDVCKEIGDIIFYQRDLKSCKNLVSFCEFESYTIKKDGKKITIGPKVAPRTSPLAQLSSILETANNITIRNRRNDELYISPEQRKAIAEFLDNHEVMKLTDLYKILNIGKKDGWWAGKAIGKGLKGNTTKCQIREALSGLPKEQVDSLTAFKLEIDECVDEETGEVRKRIDNTKAEKQPLYRLWHLLYSIKDNDELTGALRHLGIENKEIIEKLCKIDSRTAGYANKSAKAIGRILPYLMDGVMYSEACGRAGYDHSRRVNPDRVLLTHLPQIQKNELRQPVVEKILNQLVNIVNALLEKEGAIDEIRVELARELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMRRKAQGKETDEDKELWENFIDRQLRQSQYIAKKSVEMLQQVCKNVYTTSGSITDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTRITVPGKRYVIKSGKRTLAQTGIIVPRGALHAEFVYGRIQKQEADGDTKTYQYVRKYKLGIGAQGFLFNGKEFYKEELKKDSKTGLSSIVVTDKIKDVLDKIVDGGIRQRILERLNRGFEEGADYRANVARALENLKNLDEDPIYSDDAKTRPIRTVRKYVSSSTMVAVRKDSNGKAISFVEPDGNHHVAFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 1300 - protein, 1228 aa, unidentified
  REGION 1..1228: note = Description of Unknown:uncultivated organism with predicted taxonomy: Fibrobacter
  REGION 1..1228: note = MG16-219 effector
MKKILGLDLGVGSIGWSVISVDENGDPSEILGMGSRIIPLSTDDANEFSTGNAISKNQKRTQKRTARKGYDRFQLRRENLTAELRKLHMLPDEKLIKLPILELWTLRAKAATEGNKLSLPEIGRILYHINQKRGYKHAKADEAGDKQQTEYVAAVNSRYAMIKERCQTIGQYFAEKIRESEVISEKGKFYTFRTKEQVFPRKAYEEEFDKIIAVQRQYYPDVLTDSAINRLRNEIIFYQRNLKSCKHLVSLCEFEKHEYKNKEGQIVYDGPKVAPRTSPLAQICRIWEFVNNISLENGYKERRELSLEEKQKVIHFLDNNEKMTATDFSKLLGLGKKNEWDLKRYFGKNGVKGNETKVSLRNALKDFPNVEELLQFNLTLDNSNYVNESTGEVLKVISPSFQNEPLYDLWHTVYSLSDKDELSNALGKKFGISDKNAIQQLFKIDFVKPGFSNKSAKAVRRILPFLQQGLMYSEACAEAGYNHSNSLTKTENEARSLLDRLPQIKKNELRQPVVEKILNQMVNVVNAIYDDYGTIDEIRVELARELKQSKDERNTTFNNIAKRERENKGIAERIKNEYGLIPNRNKIEKYRLWEEAEQKCFYCGQTVNVKEFLSGFDVEVEHVIPKSLLFDNSYANKVCACRKCNANKGNKTAFDFMKSQSEDAFNNYVSRVEEYYKNGKISRTKHDRLLTPQSEIPSDFIERQLRQTQYISKKALEMLKEVCCKVYATNGSVTDFIRHTWGYDEILHQLNFDRYKQGGLTEVREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKRVATTGKRIKYEKGQKKVLQEGIVIPRGALSEESVYGKIKVIDPHKPLKFLFENPQTIVSPQIKTAVIDRLSKFGNDVKKAIASIKKEPLTLASDKVINDADCFKEEYVIKYPLEGFKAKDIQFVVDKHIREDVLPKRLAEFDGNEKNAFKNIDKNPIFADANHNIPIKHVRCFTGLSAVVPVKHDDAGKAIGFVKPGNNHHVAIYKDECGKLHESLVSFWNAVERKIKKVPVVITQPQDAWNIAENAHCSEEFTASLPNKTWTFVQSLQVNEMFVLGLEESAYQKAVREKDYNLINKHLYRVQSISKSDYFFRHHLETIIDDTSASKEMKRFYRFKSLGSFFKENPHKVQISVLGKLIVKE

SEQ ID NO: 1301 - protein, 1222 aa, unidentified
  REGION 1..1222: note = Description of Unknown:uncultivated organism with predicted taxonomy:Sediminibacterium sp. C3
  REGION 1..1222: note = MG16-220 effector
MKKVLGLDLGVGSIGWCLIEKDDDNTPKRIIRMGSRIVPISSDEETGYTKGNAISKNADRTAKRTARKCYDRYQLRRQALVNLIKRLYMLPNKELMLEQTPLEIWQKRADAASKEITLEALGRVLLHINQKRGYKHSRLSNADRKETAYVQEVNSRYDELKAEGLTIGQHFAAKLKENEQTSNDGKKYYNYRIKEQVYPRHAYEEEVKKILEIQSQFHADVLTPDVCREIMDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLNACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1302 - protein, 1018 aa, unidentified
  REGION 1..1018: note = Description of Unknown:uncultivated organism with predicted taxonomy:Sediminibacterium sp. C3
  REGION 1..1018: note = MG16-221 effector
MKKVLGLDLGVGSIGWCLIEKDDNNTPKRILRMGSRIVPISSDEESGYTKGNAVSKNADRTAKRTARKCYDRYQLRRQALINLLKRFGMEPNKNLMLEQTPIKLWQKRADAASKEVSLEELGRVLFHINQKRGYKHSRLSNSDSKETAYVQEVNSRYDDLKAEGLTVGQHFAAKLKENEQESADGKKYYNYRIKEQVYPRHAYEEEVKKILEVQSRYHSDILTPDVCKEIMDIIFYQRDLKSCKNLVSLCEFESYTITKDGKEITIGPKVAPRTSPLAQLSSILETANNITIRNRKNDELYISPEQRKAIADFLDNHEVMKLTDLYKILNIGRKDGWWAGKAIGKGLKGNTTKYQIREALANLPKEKVDSLTAFQLEFDEYVDEETGEVRKRINNTKAEKQPLYKLWHLLYSIKDNKELSGALCHLGIEDEESIEKLGKLDFRTAGYANKSAKAIGRILPYMMEGMMYSDACERAGFDHSKRIDPNRTLLTHLPQIQKNELRQPVVEKILNQLVNIVNALLEKEGTIDEIRVELARELKQSKDERNETFKRNSQNERNNKEYAERIKEYGLTPTRNRIMKMKMWEESEYTCVYCGQPVNVTEFLKGADVEREHIIPRGLLFDNSFTNQVCSCRLCNSKKGMRTAYDFIADDKGQAGLETYIDRINDLFNRKKISRSKFNRLLVSYKAYISRKAKGKETEEDKELWENFIDRQLRQSQYIAKKSVEMLQQVCKNVYTTSGSVTDFVRHQWGYDEILHDLNFERFKKAGLTAMVKQLHSGKEVEVERIMDWTKRLDNRHHAVDALTIACTTQGMIQRLNTLNASRDEMLEELNSKDQRVVDPERSMLEKWIFVQPHISYVEAKNEIDKIVISQRPNTRITVPGKRYVNKNGKRTLVQTDIIVPRGALHAEFVYGRILKQEADGVTMTPQYVRKYKLGIGAQGFLFNGKEFYKEELKKDSKTGLSSIVVTDKIKDVLEKIVDGGIRQRILERLNRGFEEGTDYRANVAKALANLKNLDEDP

SEQ ID NO: 1303 - protein, 1222 aa, unidentified
  REGION 1..1222: note = Description of Unknown:uncultivated organism with predicted taxonomy: Prevotella sp.ne3005
  REGION 1..1222: note = MG16-222 effector
MKKVLGLDLGVGSIGWCLLEKDDKNVPIRIIRMGSRIVPISTDEETGFTKGNAISKNADRTAKRTARKCYDRYQLRRQALVNLLRRLGMEPSKNLMLEQPPMELWQKRADAASKEISLVELGRVLLHINQKRGYKHSRLSNSDSKETAYVQEVNSRYDDLKAEGLTVGQHFAAKLKENEQLSADGKKYYNYRIKEQVYPRCAYEEEVKKILEVQSQYHSDVLTADACKEIMDIIFYQRDLKSCKNLVSLCEFESYTITKNGKEITIGPKVAPRTSPLAQLSSILETANNITIRNKRNDELYISPEQRKAIADFLDTHEVLKLTDLYKILNIGRKDGWWAGKAIGKGLKGNTTKCQIRKALSKLPKDLVDSITAFQLEFEEYVDQETGEVRKRINNTLVEKQPLYHLWHLIYSIKDVDELSGALRHLGIEDEESIRNLCDLDFRTAGYANKSAKAIGRILPYLMEGVMYSEACERAGLDHSRRIDPNRTLLKHLPPIQKNELRQPVVEKILNQLVNIVNALLEKEGAIDEVRVELARELKQSKDERNETFKRNNQNERQNKEYAERIKKYSLTPTRNRIMKLKMWEESEHACMYCEEPVDPIEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWVFVQPHISYSEAKNEIDKIVISQRPNTRMTVPGKRYVTKNGKRTLAQTGIVVPRGALHAEFVYGRIMKQEPDGITMTPQYVRKYKLGIGAQGFLFNGKEFYKEELKKDSKTGLSKIVVTDKIKEVLDKIVDGGIRQRILERLNRGFEEGADYRANVAQALTNLKNLDEDPIYSDDAKTRPIRTVRKYVSSSTMVAVRKDDKGKPVAFVEPDGNHHVAFYKDENGVISETIVTKWQAVQRKLNHIPIIIDNPSQTWSEVLGRNNVPEELLQSLPKDSSSFLLSLQIGEAFIMGMEEAELQKALEEKDMQKLAEHLYFVQNISSNNYRMRRHVESSFDTTDMNKEDQRFLNISSLDALYRLNPHKVKLTVLGDIVP

SEQ ID NO: 1304 - protein, 1222 aa, unidentified
  REGION 1..1222: note = Description of Unknown:uncultivated organism with predicted taxonomy: Prevotellacopri
  REGION 1..1222: note = MG16-223 effector
MKKVLGLDLGVGSIGWCLVEKDDKNIPLRIIRMGSRIVPITKEEENGYTRGNAISKNADRTTKRTARKCYDRYQLRRKALVNLLKRCGMMPDKGLILEQSPLDLWQKRADAASKEISLEELGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDIIFYQRDLKSCKNLVSFCEFESYTINKNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFDLIFDEYVDEETGEVRKRINNSHAERQPLYRLWHLVYSIKDNDELSGALRGLGIEDEECIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNNEYAERIKEYGLTPTRNRIMKMKMLEESEYKCMYCGQPVREKEFLQGADVEREHIIPKALLFDNSFTNQVCSCRSCNSQKGMRTAYDFIADDKGQEGLEAYIERINDLFNKKKISRSKLNRLLVSHKAYVSRKAQGKETEEDVQLWENFIDRQLRQSQYIAKKSVEILQQVCKNVYTTSGSVTDFVRHQWGYDEILHDLNFEHFKKANLTTMVKQLHSGKEVEVERIKDWTKRLDNRHHAVDALAIACTTQGMIQRLNTLNASRDAMLDELNNKEQRMIDSERSMLEKWIISQPHVSYAEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLEKIVDGGIRKRILERLNRGFEDGTDYRTNTAKALENLKNLDEDPIYSDDAKTRPIRTVRKYVNSSTMVAVRKNDNGKPVSFVEPDDNHHVAFYKDKDGVITESIVTKWQAVQRKLKHIPVIVDNPTQTWNDLVGRNDVSEELLQSLPKDNSEFLLSLQKGEAVILGLEEAAYQKAIDSNDMHTLSNHLYFVQSASLSDYRFRRHVESSFDKMGMNKEDQRFLNVKSIGAFFNYNPHKVKVTILGDIIK

SEQ ID NO: 1305 - protein, 848 aa, unidentified
  REGION 1..848: note = Description of Unknown:uncultivated organism with predicted taxonomy: Bacteroides sp.CAG:770
  REGION 1..848: note = MG16-224 effector
MKKVLGLDLGVGSIGWCLIEKDDNNVPKRILRIGSRIVPISSDEETGYTKGNAVSKNADRTAKRTARKCYDRYQLRRQALVSLLKRLGMEPNKKLMFEQTPMELWQKRADAASKEVSLEELGRVLLHINQKRGYKHSRLSNSDSKETAYVQEVNSRYDDLKAEGLTVGQHFAAKLKENEQESADGKKYYNYRIKEQVYPRHAYEEEVKKILEIQSQYHSEVLSSDVCKDIMDIIFYQRDLKSCKNLVSLCEFESYTITKDGKEITIGPKVAPRTSPLAQLSSILETANNITIRNRKNDELYISPEQRKAIADFLDNHEVMKLTDLYKILNIGRKDGWWAGKAIGKGLKGNTTKCQIREALSALSKEQIDSLTAFLLEIDEYVDEETGEVRKRINNTLAEQQPLYKLWHMLYSIKDNKELSGALNHLGIEDKESIEKLCKLDFRTAGYANKSAKAIGRILPYLMEGMMYSDACERAGFDHSRRINPERVLLTHLPQIQKNELRQPVVEKILNQLVNIVNALLEKEGAIDEIRVELARELKQSKDERNEAFKRNNQNERQNKELAERIKNYGLTPTRNRIMKLKMWEESEHSCMYCKQPVDPIEFLKGADVEREHIIPRGLLFDNSFTNQVCSCRRCNSQKGMRTAYDFIADDKGQEGLNAYIEHINDLFEKKKISRSKLNRLLVSHKAYLSRKAQGRETEEDKELWENFIDRQLRQSQYIAKKSVEMLQQVCKNVYTTSGSVTDFVRHQWGYDELLHELNIERFKKAGLTAMVKQLHSGKEVEVERIKDWTKRLDNRHHAVDAFAIACTTQGMIQRLNTLNASRDEMFEELNTKDQRLIDPERSMLEKW

SEQ ID NO: 1306 - protein, 1164 aa, unidentified
  REGION 1..1164: note = Description of Unknown:uncultivated organism with predicted taxonomy: Bacteroidales
  REGION 1..1164: note = MG16-225 effector
MATKKILGLDLGVGSIGWALIEMEDDKASSILGMGSRIVPLTTDDSTQFSKGQAITKNADRTARRTARKGYDRYQLRRAKLTQVLRQHNMLPERMDEHVIDLWRLRADAATEGKQLTLQQIGRVLYHINQKRGYKHAKADVSADSKQTKYVATVNQRYKDLQNLNQTIGQFFYQQLVDTAVQTPSGPYYTFRIKDKVFPRAAYVAEFDQIMQVQKIFYPEVLTTELINTLRNEIIFYQRPLKSCKHLVGLCEFEMKAYTNKHTGQVVYSGPKCAPRTSPLAQLCAIWEGVNNITLFNKHNEYLDITLEQRKAMVEHLCNNEKMTAKDLQKILGISSKEGWSVEKAIGKGLKGNMTLHQLRKALSKKYSDLLQFDLLMTDHVDEATGEVISRISEAIEQEPLYRLWHVVYSVQEREELGKALHKQFGIDDEAVVEALFKIDFVKPGYANKSHKFIRKLLPYLMKGYKYSEACDHIYVNHSNSMTKEQNATRELVDKIPLLLKNELRQPIIEKILNQMINIVNTLKEQHGNIDEVRVELARELKQSKDERAQTTERINKNERENKAIEERIREHGIRPSRARIQKYKMWEESQHQCFYCGKSISAAEFLSGADVEVEHIIPKSILFDDSFSNKVCACRDCNHTKDNLTARDFMETRGQAELDAYLARVNTAFEEGRISKTKRDHLLWHKEEIPQDFIDRQLRQSQYISKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNASHDDIAEAVRKVNPLMEKKYSLLEKYIYIQPHFTVQEVTDKVDGILVSFRAGKKVTTPAKRAIYRKGKRINVQDGLLVPRGALTEETVYGKLGNKYVVKYPLTHPSMKVDDIVDPTIREIVRARLAAFSGKAKDAFAKPLYSDAAQKMEIKTVRCYTGLQDKAVASVRFNAQGEPIGFAKTGNNHHIAIYQDAKGQYQESVVSFWQAVERKRYGLPIVIEDPKAIWDKLLDSDLPQEFLSTLPQDDWQFVVSLQANEMFILGMEDGDFEMAMQNKDYQLLNKYLYRVQKIRGKEYTFRYHIETTVDDKYSNEKGESKPNPALSMQMKKLISIRSFGGWLAQHPHKVRVNLLGEISEV

SEQ ID NO: 1307 - protein, 811 aa, unidentified
  REGION 1..811: note = Description of Unknown:uncultivated organism
  REGION 1..811: note = MG16-226 effector
MVPLCYRSATVNGLKKPACILYAPFGDVQDANEMRMVEDAKWNENYWYLKSRHLMWRKHFFIYFYYLTQNFACIYQKKVLPLQRKGFGINTNTYIMTKNILGLDLGVGSIGWALIQTEDDQPKRIIGMGSRIVPLTKDDSDQFTKGQAISKNADRTTRRTTRKGYDRYQLRRALLTQVLRQNGMLPECMDENMIDLWKLRSDAATDGKQLTLQQIGRVLYHINQKRGYKHAKSDNDGDSKQTKYVEEVNLRYKEIQEKNVTVGQHFYAELLNSKVESGNGPYYTFRIKDKVFPRAAYIAEFDQIMRVQKCYYPDVLTDELIETLRNRIIFYQRPLKSCKHLVGLCEFEMRPYKKDGKIVYGGPKCAPRTSPLAQLCAMWETVNNITLTNRNNERLEISNEQRQQLVQFLCTHETLKLTDLYKILGITKKDGWYGGKAIGKGIKGNVTLNQLRKALDGKYSQWLEMPIERIDVVDKNTAEAFWAVSPKVDETPLFQLWHAVYSLQNAEELTKTLQNKFGITDSQVIDALCKIDFVKPGYANKSHKFIRRLLPYLMEGMMYSEACACIQVNHSNSMTKAEREARPLAEKIELLQKNALRQPVIEKILNQMINLVNRLQQEYGSIDEARVELARELKQSRDERKDAFDRNNENEKRNKKISALISEQGIRPSRSRIQKYKMWEESEHRCMYCGKVVNLSEFLNGADVEIEHIIPRSILFDDSFSNKVCACRDCNREKDNMTAMDYMASKPEGEFEAYKQRVDEAFNAHRISKTKRDHLLWRRADIPQAFIDRQLRLSQYIATKAVEILQQGIRQ

SEQ ID NO: 1308 - protein, 854 aa, unidentified
  REGION 1..854: note = Description of Unknown:uncultivated organism with predicted taxonomy: Bacteroidales
  REGION 1..854: note = MG16-228 effector
MADFLNQHDKMGVKDLQKILGISPKDGWWAGKAIGKGLKGNTTFTQLREALGNLPDAEHLLEMKLHLVDSAVDTTTGELIRQVSPQVEEEPLFRLWHLVYSLQNEDELRKALRKQFGIDDEEILAKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKEEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQLRQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKRAATPAKRAVYQNGKRHIVQTGLQVPRGALSEETVYGKLGNKYVVKYPLGHQSMKVDDIVDPTIREIVRTRLNAFGGKAKDAFAEPLYSDAAHQMQIKTVRCYMGLQDKAVVPVRFNAKGEPVGFVKMGNNHHIAIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 1309 - protein, 887 aa, unidentified
  REGION 1..887: note = Description of Unknown:uncultivated organism with predicted taxonomy: Bacteroidales
  REGION 1..887: note = MG16-229 effector
LAQLCTVWEAVNNITLTNRQNETFEITQEQRVAMADFLNQHDKMGVKDLQKILGISPKDGWWAGKAIGKGLKGNTTFTQLREALGNLPDAEHLLEMKLHLVDSAVDTTTGELIRQVSPQVEEEPLFRLWHLVYSLQNEDELRKALRKQFGIDDEEILAKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQLRQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKRAATPAKRAVYQNGKRHIVQTGLQVPRGALSEETVYGKLGNKYVVKYPLGHQSMKVDDIVDPTIREIVRTRLNAFGGKAKDAFAEPLYSDAAHQMQIKTVRCYMGLQDKAVVPVRFNAKGEPVGFVKMGNNHHIAIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 1310 - protein, 1175 aa, unidentified
  REGION 1..1175: note = Description of Unknown:uncultivated organism with predicted taxonomy: Bacteroides sp.CAG:545
  REGION 1..1175: note = MG16-230 effector
EFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFVLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEASDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGIPAPDWKFVMSMQQNEMFVLGMEDDEFRDAMEVKDYKTLGAHLYRVQKLTSIYYVFRHQYETQLDDSKGAQIMKKFYRAQSFKALFSLHPRKVSVSLLGEMALKDD

SEQ ID NO: 1311 - protein, 890 aa, unidentified
  REGION 1..890: note = Description of Unknown:uncultivated organism with predicted taxonomy: Bacteroides sp.CAG:770
  REGION 1..890: note = MG16-231 effector
MKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNILNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRHLIRERLATCGGDCSKAVSSLKKSPLYLDEENTIMLEYGSCFKPEYVIKYSLNSIKAKDAVSIVDNHVREVVTERLAAFGDDPKKAFAEPLYADETGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMAGMDYKSLGEHLYRVQKLASLYYVFRSQYETKLDDSNNALAMRKFYRIRSFNALFSLNPRKVSISLLGEISLKDD

SEQ ID NO: 1312 - protein, 1133 aa, unidentified
  REGION 1..1133: note = Description of Unknown:uncultivated organism with predicted taxonomy: Bacteroides sp.CAG:770
  REGION 1..1133: note = MG16-232 effector
MLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFVLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLSQPHFSVQEVSDNVSRILVSFKAGKKVTTPGKRYVYRGGKRVLAQEGLLIPRGALCEESVYGRIHSLEKEVPVKKLFERIDDIVKPGIRAAVEERLRACDNDVKVACASLKKEPLYLDVEKTIPLEYGTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIDYYFRSQYETALDNSAGARMMKKFYRINSIKSLFALHPRKVSVSLLGEMALKDD

SEQ ID NO: 1313 - protein, 1010 aa, unidentified
  REGION 1..1010: note = Description of Unknown:uncultivated organism with predicted taxonomy: Bacteroides sp.CAG:545
  REGION 1..1010: note = MG16-233 effector
MDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1314 - protein, 1121 aa, unidentified
  REGION 1..1121: note = Description of Unknown:uncultivated organism with predicted taxonomy: Bacteroides sp.CAG:770
  REGION 1..1121: note = MG16-234 effector
MDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECGREPLYRLWHIIYSISDKNEQKSALKSQFGILDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIAKRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKRVTTPGKRYVYKAGRRRVVQENILVPRGALSEESVYGRIKSIEEKVPVKKLFERVDDIVKPRIRRLIRERLEACGGDCSKAVSSLKKSPLYLDEEKTIMLEYGSCFKYSYVKKSKLIQRDKKDDFINVSLIVDKHIREVVTARLAAFGGDTKKAFAEPLYADEAGKIQIRTVRCYTNSTVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1315 - protein, 1121 aa, unidentified; identical to SEQ ID NO: 1314
  REGION 1..1121: note = Description of Unknown:uncultivated organism with predicted taxonomy: Bacteroides sp.CAG:770
  REGION 1..1121: note = MG16-235 effector

SEQ ID NO: 1316 - protein, 1045 aa, unidentified
  REGION 1..1045: note = Description of Unknown:uncultivated organism with predicted taxonomy: Bacteroides sp.CAG:770
  REGION 1..1045: note = MG16-236 effector
KLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTASLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRRVVQENILVPRGALSEESVYGRIKSIEEKIPVKKLFERADDIVKPRIRRLIRERLEACGGDCSKAVSSLKKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1317 - protein, 956 aa, unidentified
  REGION 1..956: note = Description of Unknown:uncultivated organism with predicted taxonomy: Bacteroides sp.CAG:770
  REGION 1..956: note = MG16-237 effector
PILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGEHLYRVQKLTSLYYVFRHQYETQLDDSKGAQIMKKFYRVRSFNAMFALHPRKVSVSLLGEMALKDD

SEQ ID NO: 1318 - protein, 970 aa, unidentified
  REGION 1..970: note = Description of Unknown:uncultivated organism with predicted taxonomy: Bacteroides sp.CAG:545
  REGION 1..970: note = MG16-238 effector
MRIYDKEFPGRRSQTNIEQFRRTRNAGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYALSALKPKDVEFIVDEHIRKVVSERLSEYGNDPKKAFAEPLYADKSKMIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMKKFYRITSIKSLFALHPRKVSVSLLGEMALKDD

SEQ ID NO: 1319 - protein, 788 aa, unidentified
  REGION 1..788: note = Description of Unknown:uncultivated organism with predicted taxonomy: Bacteroides sp.CAG:770
  REGION 1..788: note = MG16-239 effector
LTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKACDNDVKAACTSLKEEPLYLDAEKTIPLEYGTCYKREYVIKYPISSLKTKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1320 - protein, 1182 aa, unidentified
  REGION 1..1182: note = Description of Unknown:uncultivated organism with predicted taxonomy: Bacteroides sp.CAG:709
  REGION 1..1182: note = MG16-240 effector
LSPDESSEFTSGNAASKNQKRTQKRTARKGYDRYQMRRQALTDKLRKLKMLPDEHLIKLPILDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDKLKACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKWGIPVIVRNPDEVWDVVIDKNVPEELAAGLPALGWSFVMSLQQNEMFVLGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1321 - protein, 1180 aa, unidentified
  REGION 1..1180: note = Description of Unknown:uncultivated organism with predicted taxonomy: Bacteroides sp.CAG:770
  REGION 1..1180: note = MG16-242 effector
PDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKIINQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1322 - protein, 1221 aa, unidentified
  REGION 1..1221: note = Description of Unknown:uncultivated organism with predicted taxonomy: Bacteroides sp.CAG:709
  REGION 1..1221: note = MG16-243 effector
MKKNLGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKTLLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGERYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAETIPVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1323 - protein, 1159 aa, unidentified
  REGION 1..1159: note = Description of Unknown:uncultivated organism with predicted taxonomy: Bacteroidales
  REGION 1..1159: note = MG16-245 effector
MKKKVLGLDLGVGSIGWALIETTDNQPEEIVGMGCRIVPIGKDDSDQFSKGQAISKNADRTARRTARKGYDRYQLRRALLTQVLRQNGMLPERMDENVIDLWKLRSDAATEGEKLTLPQIGRVLYHINQKRGYKHAKADDSADKKQTDYVAAVNQRYADLQAENKTIGQHFYLELLRSKVEGASGPYYTFRIKDKVFPRAAYIEEFDQIMHVQRTYYPTILTNELIDTLRNRIIFYQRPLKSCKHLVSLCEFEMRPYKTKDGRIVYGGPKCAPRTSPLAQLCAMWETVNNITLTNRDNEKLDITLEQRKQMVEFLCANKELKLTNLYKILGISKKDGWYGGKAIGKGLKGNATLLQLREALGGKYDQWLEMPVELKDSKWVDTETGEVIKEVAETIEQTPLFRLWHAVYSLQNADELAKTLREKFEITDKAVIDALCKIDFVKPGYANKSHKFIRRLLPYLMNGYQFSEACAHIGINHSNSMTAEERDSRTLVERIELLPKNALRQPVIEKILNQMINLVNRLQQEYGPIDEARIELARELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKDNATAMEYMAGKPTGEFEAYKQRVDEAFTEHRISKTKRDHLLWRRADIPQDFIERQLRQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSILERWVADQPHFSVADVTNKVDGILVSFRAGKRVTTPARRAIYSGGKRKIVQTGLQVPRGALTEDTIYGKREEGFVVKYPLDHPSMKVENILDPTIQNLVKEHIAAFGGNAKEAFKMPLFSAKGMQIKSVRCKTNLSENSVVPVKVNADGQPIGYAKKGNNHHVAIYQDKKGEYQELVVSFWDAVERKHYGVPVVIINPHEVWTDLVNKDLSQDFLNKLPHDDWQFVLSMQENEMFVLGLEDDEFNDAIERQDYNLLNKHLYRVQKISSKDYSFRYHTETKVDDKYDGIENGRSTSMSLGALFRFKSINGLFSQFPHKVKIDIMGRITKA

SEQ ID NO: 1324 - protein, 972 aa, unidentified
  REGION 1..972: note = Description of Unknown:uncultivated organism with predicted taxonomy: Bacteroides sp.CAG:770
  REGION 1..972: note = MG16-246 effector
SYTIKKDGKEITIGPKVAPRTSPLAQLSSFLETANNITIRNKRNDELYISPEQRKAIADFLDNNEVMKLTDLYKILNIGRKDGWWAGKAIGKGLKGNTTKCQIRKALSNFPKDQINSLTAFQLEFDEYVDEETGEVLKRVNNTQAEKQPLYRLWHLLYSIKDVDELSGALRHLGIEDEESITKLCNLDFRTAGYANKSAKAIGRILPYLMEGMMYSDACERAGFDHSRRINPDRDLLKSLPQIQKNELRQPVVEKILNQLVNIVNALLEKEGIIDEIRVELARELKQSKDERNEAFKRNNQNERQNKEYAERIKEYGLTPTRNRIMKMKMWEESEYTCMYCGQPVNVTEFLQGADVEREHIIPRALLFDNSFTNQVCSCRRCNSQKGMRTAYDFIEDDKGQEGLNAYIERINDLFNRKKISRSKFNRLLVSHKAYISRKAQGKETEENKELWENFIDRQLRQSQYIARKSVEMLQQVCKDVYTTSGSVTDFVRHQWGYDEILHDLNFERFKKAGLTTMVTQLHSGKEVEVERIKDWTKRLDNRHHAVDALAIACTTQGMIQRLNTLNASREGILDELNSKEERVVDPERSMLEKWIYTQPHISYAQAKEAIDNIIISQRPNIRITVPGKRYITKNGKRTLAQTGIIVPRGALHAEFVYGRIMKQGADGVTLTPQYVRKYKLGIGAQGFLFNGKEFYKEELKKDSKTDLSSIIVTDKIKDVLEKVVDGGIRQRILERLNRGFEEGTDYRANVAQALANLKNLDEDPIFSDDAKTRPIRTVRKYVSSSTMVAVRKDCNGKPIAFVEPDGNHHVAIYKDENGMITESIVTKWQAVQRKLNHIPVIIDNPSQTWSEIMGKNDVPEELLQTLPKDKSTLLLSLQIGEAFIMGMDDAEYQKAVEEKDMQALAEHLYFVQSISSSDYRFRRHIESQYDTNDINKEDLRFLRIRKIQALFEYNPQKVKVTVLGDIILLNT

SEQ ID NO: 1325 - protein, 1162 aa, unidentified
  REGION 1..1162: note = Description of Unknown:uncultivated organism with predicted taxonomy: Porphyromonassp. oral taxon 278
  REGION 1..1162: note = MG16-247 effector
MKKRILGLDLGVGSIGWALIETTDNKPEQIVGMGCRIVPISKDDNDQFSKGQAISKNADRTARRTARKGYDRYQLRRALLTQVLRQNGMLPDRMDENAIDLWKLRSDAATEGEQLTLPQIGRVLYHINQKRGYKHAKSDDNGDKKQTDYVAAVNQRYVDLQAEDKTIGQHFYLELLNSRVEGVNGPYYTFRIKDKVFPRAAYIAEFDQIMRVQQPFYPDVLTDELIDTLRNRIIFYQRPLKSCKHLVSLCEFEMRPYKTKDGRIVYGGPKCAPRTSPLAQLCAMWETVNNITLTNRNNEKLDITLDQRKQMVDFLCSNKELKLTNLYKILGISKKDGWYGGKAIGKGIKGNATLLQLREALGGKYDQWLEMPIELKDSKWVDAETGEVMKEVTEAVEQTPQFRLWHAVYSLQNVDELAKTLRTTFQITDEAVIEALCKIDFVKPGYANKSHKFIRRLLPYLMDGYQYSEACAHIGINHSNSMTAEERDERPLAERIELLPKNALRQPVIEKILNQMINLVNRLQQEYGPIDEARVELARELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQLRQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKRVTTPARRAVYRGGKRTIVQTGLLVPRGALTEDTIYGKCEDGFVVKYPLDHPTMKPENIVDPTIRRLVEKRIAAYGGNTKEAFKTPLYSAEGMEIKSVRCLTNLSEKGVVPVKYDKTGQPIGFAKKGNNHHVAIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 1326 - protein, 863 aa, unidentified
  REGION 1..863: note = Description of Unknown:uncultivated organism with predicted taxonomy: Coprobacter sp.
  REGION 1..863: note = MG16-248 effector
KLDITLEQRKQMVEFLCTNKELKLTNLYKILGISKKDGWYGGKAIGKGLKGNATLLQLREALGGKYDKWLEMPVELKDSKWVDTETGEVIKEVAETVEQTPLFKLWHAVYSLQNEDELAKTLREKFQITDAIVIDALCKIDFVKPGYANKSHKFIRRLLPYLMAGYQYSEACAHIGINHSNSMTKEEREARPLTEQIELLHKNALRQPVIEKVLNQMINLVNRLQQEYGPIDEARVELARELKQSREERDSAYKAINKNERDNAAIAAKIAEFGVRPSRSRIQKYKMWEESNHRCFYCGKIMDITQFLNGADVEIEHIIPRSILFDDSYSNKVCACRDCNHEKDNSTAMEYMESKPAGEFEAYKQRVDEAFSAHRISKTKRDHLLWRRGDIPQDFIERQLRQSQYIAVKAVEILQAGIRHVWTSGGSVTDFLRHQWGYDEILHTLNLPRYRKVDELTEIVHFEHAGQEHEEERIKNWTKRIDHRHHAIDALTVALTQQSYIQRLNTLEASHDWMEKQVKEVNTPYNEKKSVLERWIADQPHFSVSDVTDKVDGILVSFRAGKRVTTPARRAIYPGGKRTIVQTGLQVPRGALTEDTIYGKREEGFAVKYPLDHPSMKAENILDPTIRRLVEERIAAFGGNAKEAFKTPLYSAKGMEIKSVRCKTNLSENGVVPVKRNALGQPIGFAKKGNNHHVAIYKTGNEKPFDQVVSFWDAVERKRYGVSVVIDNPREMWNGLLNKELPQDFLNKLPHDDWQFVLSMQENEMFVLGMENDEFNDAIERHDYNTLNKHLYRVQKIAHNDYWFRFHIETSVDDKYGDKEKQVLNMAWSTELKKVYRFNSQGALFAQFPHKVKIDIIGRITKV

SEQ ID NO: 1327 - protein, 970 aa, unidentified
  REGION 1..970: note = Description of Unknown:uncultivated organism with predicted taxonomy: Bacteroides sp.CAG:144
  REGION 1..970: note = MG16-249 effector
ISQCEFAMREYTTADGKRIQAGPKVAPRSSPLFQVCKIWESVNNIEMKNRNGESYPFSEEERLKLFNFLDNNEKLTVTDLKRILGLSVKDKWWGGKAIGKGLQGNTTKIALKKALQGHEGLLSFHLKTVDSRHIDTETGVILQEIAPGFEKEPLYRLWHIIYSIKEPDEMASALKQQFGIEDPEVLSRLAKIDFVKAGYGNKSARFIRQILPYLQKGLKYSEACDYISINHSNSLTTAENKSRKLQPRMQQLQKNELRQPIIEKILNQMVNVVNALLDKHVSIDEVRVELARELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQLRQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKRLTTPGKRYTYKGGKREIAQSGIIVPRGALSEDSVYGVISCLEENVPVKKLFEHPDIIFKPYIRTKVENRIKEYDGDWKAALKSLKKAPIFLGDGETKPLEYATCWKKEYVIRYPLASIQKKDVKYIVDQHIRQLVSERLNAVGEKDAFKEPLFSDKAEKNPIKSVRLFTGLTHNSLSPVKYLDGFPIGYSKPGNNHHFCYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 1328 - protein, 758 aa, unidentified
  REGION 1..758: note = Description of Unknown:uncultivated organism with predicted taxonomy:Sediminibacterium sp. C3
  REGION 1..758: note = MG16-250 effector
MYSEACERAGFDHSRRIDPNRTLLTHLPQIQKNELRQPVVEKILNQLVNIINALIEKEGAIDEIRVELARELKQSKDERNETFKRNNQNERQNKEYAERIKEYGLTPTRNRIIKMKMWEESEYTCMYCGQPVNVTEFLKGADVEREHIIPRGLLFDNSFTNQVCSCRRCNSKKGMRTAYDFIADDKGQEGLNAYIDRINNLFDKKKISRSKLNRLLVSHKAYISRKAQGKETEEDKELWENFIDRQLRQSQYIAKKSVEMLQQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDVMLEELSSNDQRLVDPERSMLEKWIYVQPHISYAEAKNEVDKIVISQRPNTRITVPGKRYVTKNGKRTLAQTGIIVPRGALHAEFVYGRIMKQEADGFTMTPQYVRKYKLGIGAQGFLFNGKEFYKEELKKDSKTGLSSIVVTDKIKDVLDKIVDGGIRKRILERLNRGFVGGADYRANIAQALANLKNLDEDPIYSDDAKTRPIRTVRKYVSSSTMVAVRKDSNGKPMSFIEPDGNHHVAFYKDENGVIKESIVTKWQAVQRKLNHIPIIIDNPSQTWSEVLGRNDVPEELLQSLPKDSSTFLLSLQIGEAFIMGMEDSDYQKALEERDMRTLSEHLYFVQNISSNNYRLRRHVESSFDITDMNKEDQRFLNIKSVNSFFNNNPHKVKITILGDIIADL

SEQ ID NO: 1329 - protein, 808 aa, unidentified
  REGION 1..808: note = Description of Unknown:uncultivated organism with predicted taxonomy: Bacteroides sp.CAG:144
  REGION 1..808: note = MG16-251 effector
NALNDLDFVTPGYANLSAKAISKILPYMMEGLDYSDSCEYVGYNHSDSLTKEENEKRELLDKIPALKKNELRQPTVEKILNQTINVFNEINANFISKGERVDEVRVELARELKQSKEEREETERGIRKQQKANDGYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQLRLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKKATVPGKRKIYKNGKPITVQSRLRIPRGQLHEQTVYGAIKQYSKDKKGNVIESREIVTRYKMGVGSVGLVFNGKETCDVIYNKKKECYEIIDGIEKSINYIVDKHIREVVRERINEAFPNGETYRSEAENALAEGRVYNGKERCQKALEQLKSLDEHPLYADKNHHIVIKSVRCFTGLGAVQPLRYNNDNEPISFVLTKNNHHVAIYADENGDYKECIYTFWQVVERSKYKLPLIIKDPKALWEEIRQRENNGERFPDTLIASLPSPNWAFVESLQLNDMFVLDIDDEDFENFIANDNYEEIGKKLYRIQNISSGDYFLRLHTDTTSDRSNSKLTKKFLRKSLMGFLNSNPHKVSISILGKMKIVK

SEQ ID NO: 1330 - protein, 936 aa, unidentified
  REGION 1..936: note = Description of Unknown:uncultivated organism with predicted taxonomy: Bacteroidales
  REGION 1..936: note = MG16-252 effector
QVCKIWESVNNLSLKNRSGEVYHFSQEERRKMFDFLDNHDKMTVTDLYKLLGISKKEGWWGGKAIGKGLQGNTTKAALAKALGERQDLLQFQLETIDSRQIDTETGEVLKTISPSFEKEPLYRLWHILYSMHERSEVAAALERQFGITAPDTVDRLFAIDFVKAGYGNKSARFIREILPYLQAGMQYSQACDYIGINHSNSLTIEENASRVLLDRLPQLQKNELRQPVIEKILNQMVAVVNALLSQYGPIDEIRVELARELKQSRDERNDAYLSINKRERENKVIEERIREYGISPSKSRIQKYRLWEESNHLCFYCGHPVGAAEFLSGSGVEIEHIIPRSLLFDDSFANKVCACRKCNAEKGNSTAFDYMKSKPANDFEDYLKRVEKYFTEKRISKTKRERLLTPASEIPQDFIDRQLRQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKKVATPGKRYTYKNGKKELVQDGLLIPRGALSEESVYGQITTIEPSVPVKKLFEDPSLIFKPYIRELVERRIKECGGDWKKARASIGKKPIWLDTEETVALEFATCWKKEYVMKYPVSSLKAKDVDSIVDRHIREIVRRRIDEVGEKEAFKTPIYTDDAQSIPLRSVRLFTGLDAVEPVKYVDGVPVGFSKPGNNHHIAIYRDKDGNRSEHVVSFWHAVERKRYGLPVIIRDTDSVWDQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPHKVRISVTGELIPIQ

SEQ ID NO: 1331 - protein, 851 aa, unidentified
  REGION 1..851: note = Description of Unknown:uncultivated organism
  REGION 1..851: note = MG16-253 effector
KLKDVHEVLGINSKSGWYCDKAIKSGIKGNSTKCAIISALSSLPNSIIREITRFNLETETSNMVDEETGELLVRIKSTYQEEPLYRLWHIIYSIKNDAERLNTILVFLKEFGIEDVSIANALNDIDFVTPGYSNLSAKAISKILPYMMEGLDYSESCEYVGYNHSDSLTKEENEKRELLDQIPAIKKNELRQPTVEKILNQTINVFNQINADLGKKGERVDEVRVELARELKQSKEEREETDKGIRKQQKANEEYADILKKKGVRPTRNRILKYRLWKESEEACFYCGRDIDFHEFLRFSDVEREHVIPKKLLFDDSFANQVCSCRRCNAEKGGRTALDYMRTKPNLQEYLDKVDKLFQEHKIGGKKHAHLLASYDDYLSRKKEGKETKDDIMIWEEPIDRQLRLSQYISKKAQELLKAACREVMATSGSITDLIRHTWGYDTILHELNFPRYKDAGLTEIIKDEETGMQREVIPDWSKRLDHRHHAIDALAVACTSRSIVQRINTLNASREIIREEIKTSRKEWEDNDLLQQWIKEKMPFDRQYVVQKVASILVSMKAGKKATVPGKRKIYKNGKPVIMQTGLRIPRGQLHEQTVYGAIKHHSKDKKGNVIETKEIVTRYKMGAGSVGFVFTGKETCDVVFDKKNERYVIVDGIGKAINYIVDRHIREIVRERINEAFPDGETYLSEAEKALAEGRLYNSKDRCQKALEQLKSLDEHPLYADKNKTIVIKSVRCFTGLNAVQPLRYNSKHEPISFVLTKNNHHVAIYVDEKGEYQECVYTFWQVVERAKYRLPLIIQDPKTIWDEIRQREKDGDSFPDDLITSLPLPNWTFVESLQQNDMFVMDMDDDTF

SEQ ID NO: 1332 - protein, 919 aa, unidentified
  REGION 1..919: note = Description of Unknown:uncultivated organism with predicted taxonomy:Marinilabiliaceae
  REGION 1..919: note = MG16-254 effector
NRIIFYQRPLKSCKHLVSLCEFEARPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKHIDVVDATTSEVFWAVSPEVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAEKISEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPADFIERQLRQSQYIAVKAVEVLQDGIRQVWTSGGSVTDFLRHQWGYDEILHTLNLPRYRQVEGLTELVDFEHAGQKHTEERIKNWSKRIDHRHHAIDALTVALTQQGYIQRLNTLEASHDFMEKQVKEAGTKYNEKKSILEKWINEQPHFSVEEVTNAVDRILVSFRAGKRVTTPARRAIYKGSKKTIVQTGLQVPRGALTNDFVYTKHGKKYARKYPINAISNPENIVDATIRQLVKARLASHGGNINDAFKTPLYSAEGMEIKTVRCYNNKLSDRGVVAIKYNEQKEPIGFAETDNNHHMAIYKLADGSLKERVVSFWDAVERKRYGLPIIITNPNEVWSIVLEKDLPQDFLNKLPEDKWEYVLSLQENEMFVLGMEDDEFNDAIDTHDYNLLNKHLYRVQSISYGDYYFCHHTETKATDKNESIKLGKTLRIRGVNSLKSYFPHKVQVDLLGHIHKV

SEQ ID NO: 1333 - protein, 1221 aa, unidentified
  REGION 1..1221: note = Description of Unknown:uncultivated organism with predicted taxonomy: Bacteroidetes
  REGION 1..1221: note = MG16-255 effector
MKRVLGLDLGVGSVGWALVEKDERNIPINVNKIGSRTVPLSNDEENNFSKGAAIPTNKDRTIKRTARKCNNRYKLRREQLTNGLRALKMLPDETLFKLDPLQLWELRAKAATEKVSLPELGRVLYHLNQKRGYKHSKDNEQDSKQTDYVATVNKRYKDLQSKNLTIGQYFAQKLKESEHIQEGGKSYSFRIKDNVYPRAAYEEECKRILSTQKQFYPDILTDNNVKDLFQFIYYQRPLRSCKHLISRCSLEEQLHDVKEKDFYAPKVAPISSPLAQLDKIWEAVNNFTVRGKRNEELYITHEQRSAIVEHLEHNKDIKLTAIQKILGIGKSKEWFIKKEQLKPLQGDITRIKLAEALSSGHLSKEKIENLLLLKIDFEEMADTTTGEVMGGIVVKNNIESQPLYQLWHAIYSIDDEKALRKTLAKLGIDDDDVMDALCKISFKTSGYAKKSTRAIKKILPYLMEGYQYSDACQMAGYNHSNSITKEEEASRPLQDHIPQIQKNELRQPVVEKILNQMINIVNTLLKDGPIDEIRVELARELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQLRLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKHITTPGKRYEYKGGSKILRQQGLVVPRTALHDEFVYGRISRYDKNGILQPEIVRKYGILGGMGCLFDGKETYKETEKTDKKIGLPKIKIEDKIKDVLDKIVDGGVRKRILERLNRGFEEGKDYRNDTKKALDNLRNLDEDPIYLDDAHTIPIKTVRKFTHSTKAIPLRYNDKNEPIAFVEPGGNHHVALYETADGTVKEHVCTNWHAVQRRMYGFPAIIDNPSDAWQQASNNDKLPEDLLMHLPDDNSKFLLSMQIGDAFILGMEEYEYQAAINEKNYKLLGEYLYFVQKLSSNDYAFRRHVESKYEEKQTNKDDGRFIRIRSIDKYENYNPHKVKITLLGEIFP

SEQ ID NO: 1334 - protein, 829 aa, unidentified
  REGION 1..829: note = Description of Unknown:uncultivated organism with predicted taxonomy: Bacteroides sp.CAG:144
  REGION 1..829: note = MG16-256 effector
ERLHSIIRFLKDFDVEDILIANALNDLDFVTPGYANLSAKAISKILPYMMEGLGYSDSCEYVGYNHSDSLTKDENEKRELLDKIPALKKNELRQPTVEKILNQTINVFNEINANLISKGERVDEVRVELARELKQSKEEREETERGIRKQQKANDEYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQLRLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKKATVPGKRKIYKNGKPITVQSRLRIPRGQLHEQTVYGAIKQYSKDKKGNVIESREIVTRYKMGVGSVGLVFNGKETCDVIYNKKKECYEIVDGIEKSINYIVDKHIREVVRERINEAFPNGETYRSEAENAFAEGRVYNGKERCQKALEQLKSLDEHPLYADKNHHIVIKSVRCFTGLGAVQPLRYNNDNEPISFVLTKNNHHVAIYADENGDYKECIYTFWQVVERSKYKLPLIIKDPKALWEEIRQRENNGERFPDTLIASLPSPNWAFVESLQLNDMFVLDIDDEDFENFIANENYEEIGKKLYRIQNISSGDYFLRLHTDTTSDRSNSKLTKKFLRKSLMGFLNSNPHKVSISILGKMKIVK

SEQ ID NO: 1335 - protein, 1159 aa, unidentified
  REGION 1..1159: note = Description of Unknown:uncultivated organism with predicted taxonomy: Bacteroidia
  REGION 1..1159: note = MG16-257 effector
MIKHILGLDLGVGSIGWALIETENDQPKQIIGIGSRIVPLSKDDSDQFSKGQAISKNADRTARRTTRKGYDRYQLRRALLTQVLRQNGMLPERMDENVIDLWKLRSDAATEGHQLTLPQIGRVLYHINQKRGYKHAKADNNGDSKQTKYVETVNQRYAEIQETGQTIGQHFYLELLHSKVESGNGPYYTYRIKDKVFPRAAYIAEFDQIIKVQKAYYPEVLTDELIDTLRNRIIFYQRPLKSCKHLVSLCEFEMKPYKTKEGKIVYGGPKCAPRTSPLAQLCAMWETANNITLTNRNNEQYDFSLDERRQLVEHLCTHEVLKLTDLYKILGITKKDGWYGGKAIGKGIKGNATLNQLRKALNGKYGEWLEMPIEHIDAVDNETAEVFWQVSPKVEETPLFRLWHAVYSIQDADELAQTLRNKFGITEQEVIDALCKIDFVKPGYANKSHKFIRRLLPYLMDGMMYSEACKLLRINHSNSMTTEERDARPLAERIELLPKNALRQPVIEKILNQMINLVNRLQQEYGPIDEARVELARELKQSREEREGAYRRNNQNERLNKEIFAKIEEMGIRPSRSRIQKYKMWEESNHRCMYCGKTVSLAEFLNGAEVEIEHIIPRSILFDDSFSNKVCACRECNHEKGNLTALDYLETKPTAEQEAYKQRVDEAFKEGRISKTKRDHLLWHRSDIPTDFIDRQLRQSQYIAVKAVEILQQGIRQVWTSGGSVTDFLRHLWGYDEILHTLNLPRYRQVEELTEIVHYEHAGQEHDEERIKNWSKRIDHRHHAIDALTVALTRQAYIQRLNSLNAEFTREEMLKEVEEANTVYNEKKSLLEKWVNEQPHFSVDDVTQSVDSILVSFRAGKRVTTPARRAIYQGGKRTIVQRNIQVPRGALTNEFVYTKNGNKYARKYPIDAISNPENIVDPTIRQLIKARLAAFNGNAKEAFKEPLFSAEGMEIRTIRCYNNKLADKGVVAVKYNERQEPIGFSETDSNHHIAIYRDKSGKYQEMVVSFWDAVERKKFGVPVVISNPHDVWDSIMDKDLPQEFLVKLPKDDWTYILSMQENEMFVLGMEEDEFNDAIEAKDNAVLNKHLYRIQNISSLFYNFRYHTETKVDDKYAGIENGRNASMSLGALVPIRSFGSLFALFPHKVKIDIMGRITKA

SEQ ID NO: 1336 - protein, 943 aa, unidentified
  REGION 1..943: note = Description of Unknown:uncultivated organism with predicted taxonomy: Bacteroidales
  REGION 1..943: note = MG16-258 effector
VLTDELIDTLRNRIIFYQRPLKSCKHLVSLCEFEMRPYKTKDGRIVYGGPKCAPRTSPLAQLCAMWETVNNITLTNRNNEKLDITLDQRKQMVDFLCSNKELKLTNLYKILGISKKDGWYGGKAIGKGIKGNATLLQLREALGGKYDQWLEMPIELKDSKWVDAETGEVMKEVTEAVEQTPQFRLWHAVYSLQNVDELAKTLRTTFQITDEAVIEALCKIDFVKPGYANKSHKFIRRLLPYLMDGYQYSEACAHIGINHSNSMTAEERDERPLAERIELLPKNALRQPVIEKILNQMINLVNRLQQEYGPIDEARVELARELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQLRQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKRVTTPARRAVYRGGKRTIVQTGLLVPRGALTEDTIYGKCEDGFVVKYPLDHPTMKPENIVDPTIRRLVEKRIAAYGGNTKEAFKTPLYSAEGMEIKSVRCLTNLSEKGVVPVKYDKTGQPIGFAKKGNNHHVAIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 1337 - protein, 921 aa, unidentified
  REGION 1..921: note = Description of Unknown:uncultivated organism with predicted taxonomy: Prevotellasaccharolytica
  REGION 1..921: note = MG16-259 effector
FVNNIRLENGYKEARALSQDERLKVVDYLDNHEKMTARDFTKLLGLDKNDEWDLKKYFGKNGVQGNITKTQLATALANVSNASELLRFNLALENSNYVNESTGEVLKVISSDFQNEPLYMLWHTVYSLSDKEELKNALNKKYGITDESVLNNLFKIDFVKPGFGNKSAKAIRRILPFLQDGLVYSDACAEAGYNHSNSLTKSENEARTLLSRLPQIKKNELRQPVIEKILNQMVNVVNAIYDEYGQIDEIRVELARELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQLRQTQYIAKKALEMLKDVCYNVYATSGSVTDFIRHTWGYDEILHQLNYDRYKKGGLTEFREYDHKGETHTEERIQDWSKRLDHRHHAIDALVIAMTRQSIIQRLNHLNTERDAMFQEVEKQRKEWKNDYSMLQEWLRERKHFSAEDVAKKVSDILVSFKAGKRVATIGKRVKYEHGKKNVLQTGIVIPRGPLSEESVYGKIKVLDRNKPVKHLFENPESIVNADIKSAVTNRLIQNKSDVKKAVQSLKKSPIVLANGKTLENADCYKEEYVIKYSLNGFKAKDIDSIVDTHIKDVLYKRLEEYNGNEKEAFKDIENNPIYADAAHKIKIRNVRCFTGLSAVVPVKKDENGNAIGFVKPGNNHHVAIYKDENGNLQESVATFWHAVERKKYGLPIVITNPIDAWKLARERNCPKEFLDCLPKENWTFVQSLQINEMFVMGLTNEAYEKAVAEKDYALLNQYLYRVQKLTSNDYFVRYHLETVLDDSAEARSIKKFYRFKSLGSLFKE

SEQ ID NO: 1338 - protein, 777 aa, unidentified
  REGION 1..777: note = Description of Unknown:uncultivated organism with predicted taxonomy: Bacteroides sp.CAG:770
  REGION 1..777: note = MG16-260 effector
LYITHEQRSAIVEHLEHNKDIKLTAIQKILGIGKSKEWFIKKEQLKPLQGDITRIKLAEALSSGHLSKEKIENLLLLKIDFEEMADTTTGEVMGGIVVKNNIESQPFYQLWHAIYSIDDEKALRKTLAKLGIDDDDVMDALCKISFKTSGYAKKSTRAIKKILPYLMEGYQYSDACQMAGYNHSNSITKEEEASRPLQDHIPQIQKNELRQPVVEKILNQMINIVNTLLKDGPIDEIRVELARELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQLRLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKHITTPGKRYEYKGGSKILRQQGLVVPRTALHDEFVYGRISRYDKNGILQPEIVRKYGILGGMGCLFDGKETYKETEKTDKKIGLPKIKIEDKIKDVLDKIVDGGVRKRILERLNRGFEEGKDYRNDTKKALDNLRNLDEDPIYLDDAHTIPIKTVRKFTHSTKAIPLRYNDKNEPIAFVEPGGNHHVALYETADGTV

SEQ ID NO: 1339 - protein, 934 aa, unidentified
  REGION 1..934: note = Description of Unknown:uncultivated organism with predicted taxonomy: Bacteroidales
  REGION 1..934: note = MG16-261 effector
ATEGHKLSLPELGRILYHINQKRGYKHAKADEAGDKQQTEYVAAVNSRHAMIKERHQTIGQYFAEEIRKSEIISEKGKFYTFRTKEKVFPRKAYEEEFDKIIATQRQFYPTVLTGTTINRLRNEIIFYQRKLKSCKHLVSLCEFEKHEYKNKEGKTVFDGPKVAPRTSPLAQICRIWEFVNNISLENGYKERKELSLEEKQKVVNFLDNNDKMTATDFSKLLGLGKKNGWDLKRYFGKNGVKGNETKVSLRNALKNLPNVEDLLRFNPTLDNSNYVNEATGEVLKVISPSFQNEPLYELWHTVYSLSDKDDLSNALNKKFGISDENAVQKLFKIDFVKPGFSNKSAKAIRRILPFLQQGLMYSEACAEAGYNHSNSLTKTGNEARVLLERLPQIKKNELRQPVVEKILNQMVNVVNAIYDDYGAIDEIRVELARELKQSKDERNTTFNNIAKRERENKGIAERIKNEYGLIPNRNKIEKFRLCEESDHKCFYCGQAVNAKEFLLGSDVEVEHVIPKSLLFDDSFANKVCACRKCNAQKGNKTAFDFMKSQSEDEFNNYVSRVEEYYKNGKISRTKHDRLLTPQTEIPSDFIERQLRQTQYISKKALELLREICHNVYATSGSVTDFIRHTWGYDEILHQLNFDRYKQSGLTEIREFDNKGEIHKEERIQKWNKRLDHRHHAIDALVIAMTKQSIIQRLNHLNTERDAMFQEVEKQSIEWKNDFSLLQEWLRERKHFSTKDVANRVANILISFKAGKRVATIGKRIKYEKGQKKVLQEGIVIPRGALSEESVYGKIKVIDPHKPLKFLFENPQTVISPQIKAAVVNRLSKFENDFKKTIVSIKKEPLTLASGKVINDADCYKEEYVIKYPLEGFKAKDIPYIIDKRIREVVEKRLSEYDGNEKNAFKDLENNPVFVDANHKISIKHIRCFTGLSA

SEQ ID NO: 1340 - protein, 821 aa, unidentified
  REGION 1..821: note = Description of Unknown:uncultivated organism with predicted taxonomy: Porphyromonascatoniae
  REGION 1..821: note = MG16-262 effector
SIGWCLIEKDDNNVPKRILRIGSRIVPISSDEETGYTKGNAISKNADRTAKRTARKCYDRYQLRRQALVNLLKRLGMEPNKNLMLEQTPMELWQKRADAASKEISLEELGRVLLHINQKRGYKHSRLSNSDSKETAYVQEVNSRYNDLKAEGLTIGQHFAAKLKENEQKSTDGKKYYNYRIKEQVYPRHAYEEETKKILEVQSRYHSDVLTPDVRNEMMETIFYQRDLKSCKNLVSLCEFESYTITKDGKEITIGPKVAPRTSPLAQLSSILETANNITIRNRRNDELYISPEQRKAIADFLDNHEVMKLTDLYKILNIGRKDGWWAGKAIGKGLKGNTTKCQIREALSALPKEQVDSLTAFQLEFDEYVDEETGEVRKRINNTQAEQQPLYKLWHMLYSIKDNTELSGALNHLGIEDNESIEKLCKLDFRTAGYANKSAKAIGRILPYLMEGVMYSQACERAGLDHSRRIDPNRPMLKRLPQIQKNELRQPVVEKILNQLVNIVNALLEEEGAIDEIRVELARELKQSKDERNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDEMLEELNGK

SEQ ID NO: 1341 - protein, 973 aa, unidentified
  REGION 1..973: note = Description of Unknown:uncultivated organism with predicted taxonomy:Sediminibacterium sp. C3
  REGION 1..973: note = MG16-263 effector
MLKRLGIEPNKKLMLEQAPLELWQKRADAVSTKIALEDLGRVLLHINQKRGYKHSRLNNSDSKETAYVQEVNNRYDELKAEGLTVGQHFAAKLKDNEQTSADGKKYYNYRIKEQVFPRHAYEEEAKKILETQSRYYPDLLTPDVCKEIMNIIFYQRDLKSCKNLISYCEFESYTITKDGKEITIGPKVAPRTSPLAQLSSILESANNITIRNRKNDELYISPEQRKALADFLDNHEVMKLSDLYGILNIGRKDGWWAGKAIGKGLKGNTTKCQIREALKNLPQEKINALTSFNLEYDEYVDEETGEVRKRVNNHLAERQPLYRLWHLIYSIKDSDELAAALRRFGIDDEESILNLCNLDFRTPGYANKSAKAIGRILPYLAEGVMYSDACNMAGFDHTRRLNPNRPLLTSLPQIQKNELRQPVVEKILQQVVNIVNTLIEKEQSIDEIRVELARELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWENFIDRQLRLSQYIAKKSVEMLQQVCRNVYSTSGSVTDFVRHQWGYDELLHDLNFERYKRAGLTAMVTQLRSGKEVEVERIKDWTKRLDNRHHAVDALAIACTTQGMIQRLNTLNASREDILDELNKTEERNDDSERSMLEKWICSQPHISYAEAKDELDKIIISQRPSTRLTVPGKRYVKKDGKRTPVQAGILVPRGALHAEFVYGRIMKYGADGVTLTPQYVRKYKMGIGAQGYLFSGKEFYKEEQKKDSKTGQTSTVVTDKIKEVLDKVVDGGIRRRILERLNRGFEDGKDYRSNVPQALANLKNLDEDPIYSDDAKTRRILTVRKYVASSTMVAIRKDADGKPLAF

SEQ ID NO: 1342 - protein, 906 aa, unidentified
  REGION 1..906: note = Description of Unknown:uncultivated organism
  REGION 1..906: note = MG16-264 effector
QDGWWGGKAIGRGLQGNTTKIALKNALGDFDNAEKLLQFNLKNTDSGLIDEVTGEVIQMIDAKVEKEPLYDLWHTVYSISDKAELANALKKKFNIYDEDIINSLYAIDFVKQGFGNKSAKAMRRILPYLQQGMKYSDACEYAGFSHSDSLTKTENEARQLLEKLPPIQKNALRQPIVEKILNQMINVVNALMVEYGQFESIRVELARELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTEFDFMRSQDKAVFDDYIKRVEKWFDDGIISPSKRERLLLSHEDYLERKKKGKTTEEDKKYWEEFVSRQAGETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKKSASTGKRIKYVKRKKEVLQEGVIIPRGALHEEGVYGQIEINGEKVIVKKYKLGKGAQGFVFTGKETYEEKVNKKTGEVQVDDKIKNVLDSIVDGNIRAKVLQRLNQGFEEGKDYRNDVKKALDNLNNLDKNPIFADENKTIPIRTVRCRTGLSAVVPVKRNEQGEPIGFVKPGNNHHIAIYRDKEGQLQEHTVTFWHAVERKKYGLPVIIENPTEVWDSIMDRQLPESFLEKLPDVNWTFEMSLQQNEMFVLGMEDETFENAIREKNYSMIGAYLYRVQSISESDYWFRLHIETQNDKTPSAKLAMKYHRVKSLKAFYGLNPHKVYVSVIGKMKEL

SEQ ID NO: 1343 - protein, 992 aa, unidentified
  REGION 1..992: note = Description of Unknown:uncultivated organism
  REGION 1..992: note = MG16-265 effector
MNIIFYQRDLKSCKNLVSLCEFESYAITKNGKEITIGPKVAPRTSPLAQLSCILETANNITIRNRKNDELYISPEQRKAIADFLDNHEIMKLTDLYKILEIGRKDGWWAGKAIGKGLKGNTTKSQIRKALSSLPKEQVDSLTAFQLEYDEYVDEETGEVRKRINNALAEKQPLYRLWHLLYSIKDVDELSGALRHIGIEDDESIQKLCNLDFRTAGYANKSAKAIGRILPYLMEGLMYSEACERAGFDHSRRINPERTLLTSLPQIQKNELRQPVVEKILNQLVNIVNALLEKEGHIDEIRVELARELKQSKDERNETFKRNSQNERKNKEYAERIKEYGLTPTRNRIMKMKMWEESEHSCMYCGQPVDVKEFLQGADVEREHIVPRGLLFDNSFTNQVCSCRRCNSQKGMRTAYDFIEDDKGEAGLNSYIEHINYLFDKKQISRNKFNRLLVSHKAYINRKAQGKETEEDKELWENFIDRQLRQSQYIAKKSVEMLQLVCRNVYTTSGSVTETVRRLWGYNELLHDLNFERFKKAGLTTMVTQLHSGEEIEVERIKDWTKRLDNRHHAVDALAIACTTQGMIQRLNTLNASRDDMLKELNSQEQRVVDPEHSMLEKWIYTQPHISYVQAKEAIEKIIISQRPNTRITVPGKRYVTKNGKRTLVQTGIVVPRGALHAEFVFGRIMKQEADGKILTPQYVRKYKLGIGAQGFLFNGKEFYKEELKKDSKTGLSTIVVTDKIKDVLEKIVDGGIRKRILERLNRGFGEGTDYRANVAKALDNLKNLDEDPIFSDDAKTRPIRTVRKYVSSTTMVAVRKDSEGQPLAFVEPDGNHHVAFYKDEDGVITESIVTKWQAVQRKLNHIPIIIDNPSQTWNEVIGRNDIPDELLQTLPKDKSTLMLSLQIGEALIMGMEEADYQKAIEEKNMLALAEHLYFVQNISIGNYRLRRHVETSYDVKDMNKEDLRFLNIASIAALFNYNPHKVKITVLGDIIP

SEQ ID NO: 1344 - protein, 960 aa, unidentified
  REGION 1..960: note = Description of Unknown:uncultivated organism with predicted taxonomy: Porphyromonassp. oral taxon 278
  REGION 1..960: note = MG16-266 effector
RKHQMLPDEHLIKLPVLDLWTLRANAATEGFKLSLPEIGRVLYHINQKRGYKHAKADEAGDKKQTEYVENVNKRFAMIKDLGLTIGQFFASKLKESEVVSEKGKFYTYRTKEQVFPRGAYIAEFDQIIEVQRKFYPQVFTDEFINRLRNEIIFYQRNLKSCKHLVSLCEFEKHEYKNKDGKIVFDGPKVAPRTSPLFQICRIWEFVNNIRLENGYKEARTLSQDERLKVVDFLDNHEKMTAKDFTKLLELNKNDEWDLKRYFGKNGTQGNTTKTQLATALANIPNASELLQFNLTLENSNYVNEKTGEVLKVVSSDFQNEPLYMLWHTVYSLSDKEGLKNTLNKKYGITEESVINNLFKIDFVKPGFGNKSAKAIRRILPFLREGLVYSDACVEAGYNHSDSLTKSENEARTLLSRLPQIKKNELRQPVIEKILNQMVNIVNAIYDEYGQIDEIRVELARELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQLRQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKRVATIGKRVKYEHGKKIVLQTGITIPRGPLCEESVYGKIKVLDRNKPLKYLLENPQYIVNADIKFAITNRLAQYENDVKKAVQSLKKSPVVLANGKKLENADCYKEEFVIKYSLNGFKAKDIDSVVDNRIRNVLYKRLEEYNGNEKEAFKDIENNPIYADATHKIKIRNVRCFTGLSAV

SEQ ID NO: 1345 - protein, 765 aa, unidentified
  REGION 1..765: note = Description of Unknown:uncultivated organism
  REGION 1..765: note = MG16-267 effector
ILPYLMEGVMYRQAWERAGLHHSRRIDPNRPMLKRLPQIQKNELRQPVVEKILNQLVNIVNALLEEEGAIDEIRVDLARHLNKNKYQRNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQLRQSQYIAKKSVEMLLQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYVAKNGKRTLAQTGIIVPRGALHAEFVYGRIMKQETDGMTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAGRKGDNGKPVAFVEPDGNHHVAFYKDENGVITETIVTKWQAVQHKLYHIPIIIDNPSQTWSEVLGRNDVPEELLQSLPKDSSTFLLSLQIGEAFIMGMEDADYGRALEGKDVQSLAEHLYFVQNISSNNYRLRRHVESSFDTTDMNKEDQRFLNISSLDALFRINPHKVKLTVLGDIIP

SEQ ID NO: 1346 - protein, 983 aa, unidentified
  REGION 1..983: note = Description of Unknown:uncultivated organism with predicted taxonomy: Prevotella
  REGION 1..983: note = MG16-268 effector
VFKKRHNHKKFQSIREPSLFDDMDILDNDILYITQEQRHSMFEYMETHDRLKLCDVLRILGLNEHSGWYAGKAIGVGLQGNTTKNTILKALRTLPKEKRDMITRFELKITSRNEINENTGEVIRHIDSSYTDEPLYRLWHIIYSIQNDEERRNAISKFLQSFDIVDEVVVDKLCGIDFVKAGYGNKSAKAISKLLPYLMDGINYSDACEYVGYRHSDYLTKEENIDRELKDIIPAIKKNALRQPVVEKILNQTINIVNAVNRELRENGQGQVDIIRIELARELKMDRESRHRKFTQNNSRKRQNEEYADKINEHGIIPTRNRVIKYRLWEEANMQCFYCGQPINITELLRDPTIEKEHIIPKALLLDNSYSNLVCSCRKCNQEKGARTAYDYMRQKSDLDAYIKRINKLAETQKISQTKRLHLLASYEDYLVRKRLGKATEEDRNLWEEFINRQLSLSQYISRKAMEILQTGCRKVYATSGSITDIERHLWGYDTILHELNFPRYKCAGLTTVIKEEYEEGIITEKEVITNWSKRKDNRHHAIDALVIACTTQDTIQRINTLHASRDELQKETSGNPVFYSEKSTLLERWIKGKQPIPRHEVLEQVKQIAISIKAGKKVTTPGKRKTYKQGKPKLIQTGLLIPRGQLHEETIYGQINVPVKTKNGTIRQEPKSVVRYKLGCGKGFVFSGKETCKVEKDKKTDEYFITDEIDKALSYIVDKHIREVIRQRLNRPFPEGETYRTKAEQAQKDGRIYDGEEECKQALQGIRNLDIDPLFADKDGRIPILRVRCFTGLTLLQPLRYNSEGKPISFVSLGNNHHIALYKQTNGDIVEHVVTFWHAVERSTRGIPIVIKRPDDVWNDILNKPSDELPESFLNQLPYPNATYITSMQQNEMFILGMSQDEYQDAIACNNQTELCRHLYRVQSLSTNQYYFRLHIESENDKTLAGMKAGKFIRCKSIGSFLRLNPHKVTVTLLGKIIINNS

SEQ ID NO: 1347 - protein, 992 aa, unidentified
  REGION 1..992: note = Description of Unknown:uncultivated organism with predicted taxonomy: Bacteroidales
  REGION 1..992: note = MG16-269 effector
MDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1348 - protein, 1159 aa, unidentified
  REGION 1..1159: note = Description of Unknown:uncultivated organism with predicted taxonomy: Bacteroidales
  REGION 1..1159: note = MG16-270 effector
MKKKVLGLDLGVGSIGWALIETTDNQPEEIVGMGCRIVPIGKDDSDQFSKGQAISKNADRTARRTARKGYDRYQLRRALLTQVLRQNGMLPERMDENVIDLWKLRSDAATEGEKLTLPQIGRVLYHINQKRGYKHAKADDSADKKQTDYVAAVNQRYADLQAENKTIGQHFYLELLRSKVEGASGPYYTFRIKDKVFPRAAYIEEFDQIMHVQRTYYPTILTDELIDTLRNRIIFYQRPLKSCKHLVSLCEFEMRPYKTKDGRIVYGGPKCAPRTSPLAQLCAMWETVNNITLTNRDNEKLDITLEQRKQMVEFLCANKELKLTNLYKILGISKKDGWYGGKAIGKGLKGNATLLQLREALGGKYDQWLEMPVELKDSKWVDTETGEVIKEVTEKIEQTPLFRLWHAVYSLQNADELAKTLREKFQITDKAVIDALCKIDFVKPGYANKSHKFIRRLLPYLMNGYQFSEACARIGINHSNSMTAEERDSRTLVEQIELLPKNALRQPVIEKILNQMINLVNRLQQEYGPIDEARIELARELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKGNSTAMEYMEGKPTGEFEAYKQRVDEAFTEHRISKTKRDHLLWRRADIPQDFIERQLRQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSVLERWVADQPHFSVADVTDKVDGILVSFRAGKRVTTPARRAIYSGGKRKIVQTGLQVPRGALTEDTIYGKREEGFVVKYPLDHPSMKVENILDPTIRNLVKEHIVAFGGNAKEAFKMPLYSAKGMQIKSVRCKTNLSENSVVPVKVNADGQPIGYAKKGNNHHVAIYQDKKGEYQELVVSFWDAVERKHYGVPVVIINPHEVWTDLVNKDLSQDFLNKLPHDDWQFVLSMQENEMFVLGLEDDEFNDAIERHDYNLLNKHLYRVQNISNKDYSFRYHTETKVDDKYDGIENGRSTSMTLGALFRFKSISGLLSHFPHKVKIDIMGRITKA

SEQ ID NO: 1349 - protein, 1161 aa, unidentified
  REGION 1..1161: note = Description of Unknown:uncultivated organism with predicted taxonomy: Bacteroidales
  REGION 1..1161: note = MG16-271 effector
MTKKILGLDLGVGSIGWALIETQDDKPSQILGIGSRIVPISNDDSDQFQKGQAITKNAERTQRRTARKGYDRYQLRRALLTNLLREKNMLPDYMNESAIDLWRLRSDAATEGKKLSLKEIGRVLYHINQKRGYKHSKADVSADSKQTKYVQEVNKRFQELKELGQTIGQHFYQMLQQSVVQSEKGVYYTYRIKDKVYPRRAYEEEFDKIMSTQKVFYPDILTDEFIDTLRNRIIFYQRPLKSCKHLVGLCEFEMRPYKKADGSIVYSGPKCAPRTSPLAQICAVWEAVNNIKLTNRNNEIYPISQEERQAMVDFLQTHKEMKVADMQRILGIKKSDGWWGGKAIGKGIKGNQTLCQLREALGEKYQELLKMEIKKIDSGFFDAETAEVIEIIDPACENEPLFQLWHVVYSVQDKDELRKALLKKFNIDDEQVVENLYNLDFVKPGYANKSHKFIRRILPYLMQGEMYSVACARVGINHSNSRTKEELNTRPLVEHIKLLQKNTLRQPVIEKILNQMINIVNALRDKYGEIAEVRVELARELKQNKEERETTYKNNSKNERLNREITERIKEMGIRPSRMRVQKYKLWEESLHQCFYCGKTVGAAEFLSGADVEIEHIIPRSVLFDDSYSNKVCACRECNHAKNNQTAFDFMKAQSTDKFEAYKSRVDDAFKEKRISKTKRDHLLWGLEDIPQDFIDRQLRQSQYIAAKAVEILQTAIRDVHATSGSVTELLRHQWGYDEILHHLNLPRYNKADLTEIVQYDHAGQKHTVERIKNWNKRLDQRHHAVDALTIALTKQSYIQRLNTLNASRETIYNEVEQADAKLRNEEKRTLLENWVAIQPHFPVKDVEDKVAGILVSFRAGKRVTTPAKRAVYRNGKRINVQKGLLVPRGALTEETVYGKLGDRFVVKYPHQHPSMSPDNIVDPTIRELVKKRLSEFNNDPKQAFATPLYSDKAQKMEIKSVRCFAPGVSAQGSTPVRFNNDGNPIGYSKTGNNHHIAIYKDANGKYKESVVSFTEAVHRKLIGLPIVIDNPKQVWDKVINMNLPEDYLLTLPQDNWEFVVSMQVNDMFIMGLTDVEFEDAIHEKDYALLNQHLYRVQKLSSTKYYFRYHLETSVDDKYDGVANEKLSMEIGKLINLRSPNAMAVNVHKVRISILGEITPL

SEQ ID NO: 1350 - protein, 763 aa, unidentified
  REGION 1..763: note = Description of Unknown:uncultivated organism with predicted taxonomy: Bacteroides sp.CAG:770
  REGION 1..763: note = MG16-272 effector
EAYTIKKDGKEITIGPKVAPRTSPLAQLSSIFETANNITIRNRRNDELYISPEQRRAIADFLDNHEVMKLTDLYKILNIGRKDGWWAGKAIGKGLKGNTTKCQIREALSILPKEQVDSLTAFQLEFDEYVDEETGEVRKRINNARAEQQPLYKLWHLLYSIKDNDELSGALRHLGIEDEESIEKLCKLDFRTAGYANKSSKAIGRILPYLMEGVMYSEACERAGFDHSRRINPDRILLTHLPQIQKNELRQPVVEKILNQLVNIVNALLEKEGAIDEIRVELARELKQSKDERNEAFKRNNQNERQNKDYAERIKEYGLTPTRNRIMKMRMWEESEYTCMYCGQPVNVTEFLKGADVEREHIIPRGLLFDNSFTNQVCSCRRCNSKKGMRTAYDFIADEKGQEGLDTYIDRINDLFNRKKISRSKLNRLFVSYKAYMSRKAQGKETDEDKDLWENFIDRQLRQSQYIAKKSVEMLQQVCKNVYTTSGSVTDFVRHQWGYDELLHELNFERFKKAGLTAMVKQLHSGKEIEVERIKDWTKRLDNRHHAVDALAIACTTQGMIQRLNTLNASRDEMQEELSSKEQRLVDPERSMLEKWIFAQPHISYAEAKNEIDKIIISQRPNTRITVPGKRYVTKNGKRTLAQTGIIVPRGALHAEFVYGRIMKQEADGVTMIPQYVRKYKLGIGAQGFLFNGKEFYKEELKKDSKTGLSSIVVTDKIKDVLEKIVDGGIRQRILERLNRGFEEGTDYRSNVAQALDNLKNLD

SEQ ID NO: 1351 - protein, 1016 aa, unidentified
  REGION 1..1016: note = Description of Unknown:uncultivated organism with predicted taxonomy: Bacteroidetes
  REGION 1..1016: note = MG16-273 effector
VLLHINQKRGYKHSRLSNSDSKETAYVQEVNSRYDDLMAEGLTIGQHFAAKLKENEQESIDGKKYYNYRIKEQVYPRHAYEEEAKKILEVQSRYHSDVLTPDVCKEMMGIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCLIREALSALPKEQVDTLTSFQLEFDEYVDEETGEIRKRINNTLAEQQPLYKLWHMLYSIKDNTELSGALHHLGIEDKESLEKLCRLDFRTAGYASKSAKAIGRILPYLMEGVMYSEACERAGLDHSRRIDPNRTLLTHLPQIQKNELRQPVVEKILNQLVNVVNALLEKEGAIDEIRIELARELKQSKDERNETFKRNNQNERQNKEYAERIKKYGLTPTRNRIMKLKMWEESEHACMYCEQPVDPIEFLKGADVEREHIIPRGLLFDNSFTNQVCSCRRCNSKKGMRTAYDFIADDKGQEGLNAYIEHINDLFDKKKISRSKLNRLLVSHKAYISRKAQGKETEEDKELWENFIDRQLRLSQYIAKKSVEMLQQVCKNVYATSGSITDFVRHQWGYDELLHDLNFERFKKAGLTTMVKQLHSGEEVEVERIANWTKRLDNRHHAVDALAIACTTQSMIQRLNTLNASRDDMLEEQNSKDQRLVDPERSMLEKWVFIQPHITYADAKKEIDKIVISQRPNTRITVPGKRYITKNGKRTLVQTGIIVPRGALHAEFVYGRIMKRDIDGVTMTPQYVRKYKLGIGAQGFLFNGKEFYKEELKKDSKTGLSKIVVTDKIKDVLEKIVDGGIRQRILERLNRGFEEGADYRANVAQALANLKNLDEDPVYSDDAKTRPIRTVRKYVSSSTMVAVRKDDKGKPVAFVEPDGNHHVAFYKDDNGVITETIVTKWQAVQRKLYHIPIIIDNPSQTWSEVLERNDVPDELLQSLPKDSSTFLLSLQIGEAFIM

SEQ ID NO: 1352 - protein, 951 aa, unidentified
  REGION 1..951: note = Description of Unknown:uncultivated organism with predicted taxonomy: Bacteroidales
  REGION 1..951: note = MG16-274 effector
LFITREQKQQIANIMDNKEVLKLKDVHEVLGINSKSGWYCDKAIKSGIKGNSTKCAIISALSSLPNSTIREITRFNLETETTNMVDEETGELLVRIKSTYQEEPLYRLWHIIYSIKNDAERLNTILVFLKEFGIEDVSIANALNDIDFVTPGYANLSAKAISKILPYMMEGLDYSESCEYVGYNHSDSLTKEENEKRELLDQIPAIKKNELRQPTVEKILNQTINVFNQINAELGKKGERVDEVRVELARELKQSKEEREETDKGIRKQQKANEEYADILKKKGVRPTRNRILKYRLWKESEEACFYCGRDIDFHEFLRFSDIEREHVIPKKLLFDDSFANQVCSCRRCNAEKGGRTALDYMRTKPNLQEYLDKVDKMFQEHKIGGKKHTHLLASYDDYLSRKKEGKETKDDILIWEEPIDRQLRLSQYISKKAQELLKTACREVMATSGSITDLIRHTWGYDTILHELNFPRYKDAGLTEIIKDEETGMQRELIPDWSKRLDHRHHAIDALAVACTSRSIVQRINTLHASREIIRDEIKTSRKEWEDNDLLQQWIKEKMPFDRQYVVQKVASILVSMKAGKKATVPGKRKIYKNGKPVIMQTGLRIPRGQLHEQTVYGAIKHHSKDKKGNVIETKEIVTRYKMGVGSVGFVFTGKETCDVVFDKKNERYVIVDGIGKAINYIVDRHIREIVRERINEAFPDGETYLSEAEKALAEGKPYNGKGRSQKALEQLKALDEHPLYADKNKTIVIKSVRCFTGLNAVQPLRYNSKHEPISFVLTKNNHHVAIYVDEKGEYQECVYTFWQVVERAKYRLPLIIQDPKTIWDEIRQREKDGDSFPDDLITSLPLPNWTFVESLQQNDMFVMDMDDDTFKENVTSNNYKELGEKLYRVQNLSTHDYFFRLHSDTTSKTTPDLAQCKKFIRIKSFKAYFEHNPHKVQLSLLGKIILKND

SEQ ID NO: 1353 - protein, 984 aa, unidentified
  REGION 1..984: note = Description of Unknown:uncultivated organism with predicted taxonomy: Bacteroidetes
  REGION 1..984: note = MG16-275 effector
YENKEGKIVFGGPKVAPKSSPLFQICKIWEAVNNITLKNRKNDELYITLEQRKAMVDFLDTHEKLTLKEVYSILGISKQDGWWGGKAIGRGLQGNTTKIALKNALGDFDNAEKLLQFNLKNTDSGLIDEVTGEVIQMIDAKVEKEPLYDLWHTVYSISDKAELANALKKKFNIYDEDIINSLYAIDFVKQGFGNKSAKAMRRILPYLQQGMKYSDACEYEGFSHSDSLTKTENEARQLLEKLPPIQKNALRQPIVEKILNQMINVVNALMVEYGQFESIRVELARELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTAFDFMRSQDKAMFDDYIKRVEKWFDDGIISPSKRERLLLSHEDYMERKKKGKTTEEDKKYWEEFVSRQAGETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKKSASTGKRIKYVKGKKEVLQEGVIIPRGALHEEGVYGQIEINGEKVIVKKYKLGKGAQGFVFTGKETYEEKVNKKTGEVQVDDKIKNVLDSIVDGNIRAKVLQRLNQGFEEGKDYRNDVKKALDNLNNLDKNPIFADENKTIPIRTVRCRTGLSAVVPVKCNEQGEPIGFVKPGNNHHIAIYRDKEGQLQEHTVTFWHAVERKKYGLPVIIENPTEVWDSIMDRQLPESFLEKLPVVNWTFEMSLQQNEMFVLGMEDETFENAIREKNYSMIGAYLYRVQSISESDYWFRLHIETQNDKTPSAKLAMKYHRVKSLKAFYGLNPHKVYVSVIGKMKEL

SEQ ID NO: 1354 - protein, 1348 aa, unidentified
  REGION 1..1348: note = Description of Unknown:uncultivated organism with predicted taxonomy: Clostridiales
  REGION 1..1348: note = MG18-1 effector
MDQSKEYYIGLDGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWAVFARLLPEGKTISEVKTEEYEAYKADLRALKQLVKQYASDQYYRVFRSAKIKGNYASYVGKTNCGNEKSNPESCKPEEFFAFLKKELKPLWSQNIPAAASLAAKLESGTLLRRQRSGENAAIPYQAHLQELQIILKNMQQFYPFLQKADENGFTPAYKIEKLLTFRIPYYVGPLNDAHKEKGFCWIVKKADVPVLPWNFDQVVDENACEDAFIGRMSATCTYLVGENVLPQNSPLYCRFMVLNELNNLRIRSEKITPALKQAIFTQLFCAGKGGKVTQKKLLDFLHSQGIDANKQDISGIDGDFKASMAPAVKLQSIFTEPLPPEILERLAFALTVSGESHKMLQNRIRAILPNADNAVIRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGAAHAGILLASKNIDGKVPVSIVHQSVTGYFTQEVCLNDL

SEQ ID NO: 1355 - protein, 1379 aa, unidentified
  REGION 1..1379: note = Description of Unknown:uncultivated organism with predicted taxonomy:Phascolarctobacterium succinatutens
  REGION 1..1379: note = MG18-3 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRHQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGKGELFKQNPLKANSGQLPLKAGLSIEKYGGYNSLTTAYFAVVKSEGKKGAVQLSIEAIPLVYAKQGEIAVQNYLTEVVQLCKPEIMLSKIKKYSLFKINGFPMHISGRTDNRILFYGAGQLCIDEADADYLKKALKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQKVDLMKL

SEQ ID NO: 1356 - protein, 1379 aa, unidentified
  REGION 1..1379: note = Description of Unknown:uncultivated organism with predicted taxonomy:Phascolarctobacterium succinatutens
  REGION 1..1379: note = MG18-4 effector
MQKLKNCDYYIGLDMGDASVGWAVTDTNYNILKFNGKALWGIRLFDSANTAASTRVFRSGRRRIDRTTWRLKMLQELFADEIAKVETGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVATILKTAYKHSEIVYVKAGNVSDFRQKFEFVKCRDVNDLHHAKDAYLNIVVGNCYHVKFTDKPMDFIKKNQDNRSYSLKPEIFYKFSIKRDSEIAWVGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1357 - protein, 1379 aa, unidentified
  REGION 1..1379: note = Description of Unknown:uncultivated organism with predicted taxonomy:Phascolarctobacterium succinatutens
  REGION 1..1379: note = MG18-5 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1358 - protein, 1379 aa, unidentified
  REGION 1..1379: note = Description of Unknown:uncultivated organism with predicted taxonomy:Phascolarctobacterium
  REGION 1..1379: note = MG18-6 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYENHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSNIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGEDGTMAIVARTMHKNNILFTRQAVEGKGELFKQNPLKANSGQLPLKAGLSVEKYGGYDSLTTAYFAVVKSEGKKGAVQLSIEGIPLVYARQGEDAIKKYLIEVVHLCNPIIKLNKIKKYSLFKINGFPMHISGRHGKQLIFYVAGQLCLDEESIAYLKKAFKYESDLAINEEIIDDKNAAEENKQKAHEKLGFYENTWGISEASNMRLYDILIAKSANNFYKNRPASQTSVLKQQRDKFAKLPLSKQIRVINEAINLFKCASATADFKLLEKGSACGKIQVSTNITKCKQCILINQSPTGVFEQEVDLMKL

SEQ ID NO: 1359 - protein, 1383 aa, unidentified
  REGION 1..1383: note = Description of Unknown:uncultivated organism with predicted taxonomy:Acidaminococcales
  REGION 1..1383: note = MG18-7 effector
MQNKKNVDYYVGLDMGDASVGWAVTDLNYNILKFNGKALWGIRLFDSAETAAARRGFRSARRRIDRVSWRISMLQELFAEEIAKVDAGFFQRLKDSRLQVEDKQEKTAYNLFVGQNYTDKDFYQQYPTMYHLRYALATQAGPFDVRLLYLAVQHIVKHRGHFLFENLDASKVGDFVAVFGEVESYVHDEMELDEWYCHDIDALAKVLCNANLGITAKQKAIQNLLPAKTKQEKAIVQLLSGGKAKLCDLFCDEELAECEKKSISFQEDNLDELEPILEAILQERYEALLRFKAVYDWSLLAKILRLDADKKSENEMHLLSECKVKVYEEHKKDLAVLKSMLKGKPLYNKLFRQDGEDTYANYAQGIKGINQVDFCKSLKKQLESIGEYKKQMQQLTSFEDAQTDVERLLFRVANGLAFPKQTTKDNGIIPIQVHLAELQCILAHAEKYLPFLKNADANGLSVREKITQIVKFRIPYYVGPLAGTRLSREQGRCWVERRAELKNEKIYPWNFDKVVDLEASAENFITNMTAKCTYLVGEDVLPKESLLYSEFMVRNALNNLTIDGERLPVSLLQKIYKQLFLEKTFKVTKKALERFFKQENVSYHDIGGIDDKINASMKAYNDFKRIFGEAYIEMHRDEIENIIRWITLFCDEKKMLETKIRKTYPQIPDDKIKAIKKLKYKDWGRLSATLLDSGKIAYEDASVGERITIISALRHTNKNFMELLSSNCQYDFIGKIKDFNGSKQSDNGKLTYKDVEELYVSPSVKRSIWQTLTILEEIKKIMGCEPKRIFIEMARSKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQLVETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGKGELFKQNPLKAKSGQLPLKAGLSIDKYGGYDSLSTAYFALVESEGKKGAVQFTIEAIPLVYAKQGEATIKKYLTEVVQLCKPEIKVMRIKKYSLLKINGFPMHISGRTGKQLIFYVASQLCIDENSVAYLKKALKYESNLEENEAILADKNADESMKQKAFNRLEFYKNTWEISAVANLQIYDMLLAKSANNLYKNRPASQTATLKEKREQFAKLSLSKQIHVIKEILNLFKCASASADFKLLDKGTSCGTLKVSNNITKLKQCVLINQSPTGVFEQEVDLMKL

SEQ ID NO: 1360 - protein, 1379 aa, unidentified
  REGION 1..1379: note = Description of Unknown:uncultivated organism
  REGION 1..1379: note = MG18-8 effector
MQKSKNCDYYIGLDMGDASVGWAVTDTNYNISKFNGKALWGIRLFDYANTAASTRVFRSGRRRIDRTTWRLKMLQELFADEIAKVDTGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTVEEHLLFRITNGFAFPKQTTKDNGIIPIQVHLAELKCILDNAEGYLPFLGETNNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCKEENIDFVPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGKGELFKQNPLKANSGQLPLKAGLSIEKYGGYNSLTTAYFAVVKSEGKKGAVQLSIEAIPLVYAKQGEIAVQNYLTEVVQLCKPEIMLSKIKKYSLFKINGFPMHISGRTDNRILFYGAGQLCIDEADADYLKKALKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQEVDLMKL

SEQ ID NO: 1361 - protein, 1379 aa, unidentified
  REGION 1..1379: note = Description of Unknown:uncultivated organism with predicted taxonomy:Phascolarctobacterium succinatutens
  REGION 1..1379: note = MG18-9 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1362 - protein, 1379 aa, unidentified; identical to SEQ ID NO: 1361
  REGION 1..1379: note = Description of Unknown:uncultivated organism with predicted taxonomy:Phascolarctobacterium
  REGION 1..1379: note = MG18-10 effector

SEQ ID NO: 1363 - protein, 1379 aa, unidentified
  REGION 1..1379: note = Description of Unknown:uncultivated organism with predicted taxonomy:Phascolarctobacterium succinatutens
  REGION 1..1379: note = MG18-11 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1364 - protein, 1379 aa, unidentified
  REGION 1..1379: note = Description of Unknown:uncultivated organism with predicted taxonomy:Phascolarctobacterium succinatutens
  REGION 1..1379: note = MG18-12 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1365 - protein, 1379 aa, unidentified; identical to SEQ ID NO: 1356
  REGION 1..1379: note = Description of Unknown:uncultivated organism with predicted taxonomy:Phascolarctobacterium succinatutens
  REGION 1..1379: note = MG18-13 effector

SEQ ID NO: 1366 - protein, 1379 aa, unidentified; identical to SEQ ID NO: 1361
  REGION 1..1379: note = Description of Unknown:uncultivated organism with predicted taxonomy:Phascolarctobacterium
  REGION 1..1379: note = MG18-14 effector

SEQ ID NO: 1367 - protein, 1379 aa, unidentified
  REGION 1..1379: note = Description of Unknown:uncultivated organism with predicted taxonomy:Phascolarctobacterium succinatutens
  REGION 1..1379: note = MG18-15 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDEFAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPHISDDKIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSVWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQLVETRQSTKAVAAILKTAYQNSEVVYVKAGNVSDFRQQFKFEKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1368 - protein, 1379 aa, unidentified; identical to SEQ ID NO: 1364
  REGION 1..1379: note = Description of Unknown:uncultivated organism with predicted taxonomy:Phascolarctobacterium succinatutens
  REGION 1..1379: note = MG18-16 effector

SEQ ID NO: 1369 - protein, 1379 aa, unidentified; identical to SEQ ID NO: 1361
  REGION 1..1379: note = Description of Unknown:uncultivated organism with predicted taxonomy:Phascolarctobacterium
  REGION 1..1379: note = MG18-17 effector

SEQ ID NO: 1370 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-18 effector

SEQ ID NO: 1371 - protein, 1379 aa, unidentified; identical to SEQ ID NO: 1361
  REGION 1..1379: note = Description of Unknown:uncultivated organism with predicted taxonomy:Phascolarctobacterium
  REGION 1..1379: note = MG18-19 effector

SEQ ID NO: 1372 - protein, 1379 aa, unidentified; identical to SEQ ID NO: 1361
  REGION 1..1379: note = Description of Unknown:uncultivated organism with predicted taxonomy:Phascolarctobacterium
  REGION 1..1379: note = MG18-20 effector

SEQ ID NO: 1373 - protein, 1379 aa, unidentified; identical to SEQ ID NO: 1361
  REGION 1..1379: note = Description of Unknown:uncultivated organism with predicted taxonomy:Phascolarctobacterium
  REGION 1..1379: note = MG18-21 effector

SEQ ID NO: 1374 - protein, 1379 aa, unidentified; identical to SEQ ID NO: 1356
  REGION 1..1379: note = Description of Unknown:uncultivated organism with predicted taxonomy:Phascolarctobacterium
  REGION 1..1379: note = MG18-22 effector

SEQ ID NO: 1375 - protein, 1379 aa, unidentified
  REGION 1..1379: note = Description of Unknown:uncultivated organism with predicted taxonomy:Phascolarctobacterium succinatutens
  REGION 1..1379: note = MG18-23 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELSVDEELDECEKKSVSFQDDDLNEFEPVLTAALGERYEGLLRFKAIYDWSLLAKILHLDTSKKDEGEQHLLSECKVQVYENHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVVRTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1376 - protein, 1379 aa, unidentified
  REGION 1..1379: note = Description of Unknown:uncultivated organism with predicted taxonomy:Phascolarctobacterium
  REGION 1..1379: note = MG18-24 effector
MQKLKNCDYYIGLDMGDASVGWAVTDTNYNILKFNGKALWGIRLFDSANTAASTRVFRSGRRRIDRTTWRLKMLQELFAEEIAKVDSGFFMRLEDSRLQLDDKREKAVYNLFVDKNYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTIKQKAMQSLLPAQTKQQKAIIQLFSGGKAKLAELFLDEELDECEKKSVSFQDDDLDELEPVLTAALGERYEGLLRFKAIYDWSLLAKILHLDAEKKDDSEQHLLSECKVQVYEEHKRDLTVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGNRLVFYGAGQLCISENETVYLKRALKYRDSIEENENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 1377 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-25 effector

SEQ ID NO: 1378 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-26 effector

SEQ ID NO: 1379 - protein, 1379 aa, unidentified
  REGION 1..1379: note = Description of Unknown:uncultivated organism with predicted taxonomy:Phascolarctobacterium succinatutens
  REGION 1..1379: note = MG18-27 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSLEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1380 - protein, 1379 aa, unidentified
  REGION 1..1379: note = Description of Unknown:uncultivated organism with predicted taxonomy:Phascolarctobacterium
  REGION 1..1379: note = MG18-28 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVVTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSNIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1381 - protein, 1379 aa, unidentified
  REGION 1..1379: note = Description of Unknown:uncultivated organism with predicted taxonomy:Phascolarctobacterium succinatutens
  REGION 1..1379: note = MG18-29 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1382 - protein, 1148 aa, unidentified
  REGION 1..1148: note = Description of Unknown:uncultivated organism with predicted taxonomy:Phascolarctobacterium succinatutens
  REGION 1..1148: note = MG18-30 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKVVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKMEQFSYL

SEQ ID NO: 1383 - protein, 1148 aa, unidentified; identical to SEQ ID NO: 1382
  REGION 1..1148: note = Description of Unknown:uncultivated organism with predicted taxonomy:Phascolarctobacterium succinatutens
  REGION 1..1148: note = MG18-31 effector

SEQ ID NO: 1384 - protein, 1379 aa, unidentified
  REGION 1..1379: note = Description of Unknown:uncultivated organism with predicted taxonomy:Phascolarctobacterium succinatutens
  REGION 1..1379: note = MG18-32 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVYDFNAVFSEVENYVRDEMGIEDWSCQNIDELAKVLYDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHEPKRIFIEMARSKEESKRTDSRLKKLQDLYKQCREENIDFMPRKDEFNTLKTQLSSKKEDDLRIDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGTSCGVIKTSNNITKCEQCILINQSPTGVFEQEVDLMKL

SEQ ID NO: 1385 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-33 effector

SEQ ID NO: 1386 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-34 effector

SEQ ID NO: 1387 - protein, 1379 aa, unidentified; identical to SEQ ID NO: 1364
  REGION 1..1379: note = Description of Unknown:uncultivated organism with predicted taxonomy:Phascolarctobacterium succinatutens
  REGION 1..1379: note = MG18-35 effector

SEQ ID NO: 1388 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-36 effector

SEQ ID NO: 1389 - protein, 1379 aa, unidentified
  REGION 1..1379: note = Description of Unknown:uncultivated organism with predicted taxonomy:Phascolarctobacterium succinatutens
  REGION 1..1379: note = MG18-37 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIGFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKEKAQKGLDFYEQKWGISGAVNVQLYDMFIAKSANNLYKNRPVSQTITLKEKREHFVKLTVSKQIHIIKEILNLFKCASASDDFKLIDKGTSCGTLKISNNINKLKECILINQSPTGVFEQEVDLMKL

SEQ ID NO: 1390 - protein, 1379 aa, unidentified
  REGION 1..1379: note = Description of Unknown:uncultivated organism with predicted taxonomy:Phascolarctobacterium
  REGION 1..1379: note = MG18-38 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1391 - protein, 1379 aa, unidentified
  REGION 1..1379: note = Description of Unknown:uncultivated organism with predicted taxonomy:Phascolarctobacterium
  REGION 1..1379: note = MG18-39 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1392 - protein, 1379 aa, unidentified
  REGION 1..1379: note = Description of Unknown:uncultivated organism with predicted taxonomy:Phascolarctobacterium succinatutens
  REGION 1..1379: note = MG18-40 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVVSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQPLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1393 - protein, 1291 aa, unidentified
  REGION 1..1291: note = Description of Unknown:uncultivated organism with predicted taxonomy:Phascolarctobacterium succinatutens
  REGION 1..1291: note = MG18-41 effector
MQKLQNKDYYIGLDMGDASVGWAVTDANYNILKFNGKALWGIRLFDSANTAASTRVFRSGRRRIDRTTWRLKMLQELFADEIAKVDPGFFMRLEDSRLHLDDKRENAVYNLFVDKNYTDKEFHQQYPTMYHLRYALATKKGPFDIRLLYLAVQHIAKHRGHFLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLSFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKIQLNSKKDYDLRSDKLYLYYTQMGRCMYTGERIELASLYDDNLYDIDHIYPRSKTKDDSLSNRVLVKKEVNAAKTDIYPLDAAIRTKMHSFWKLLYDKGLIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTAHPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKI

SEQ ID NO: 1394 - protein, 1379 aa, unidentified; identical to SEQ ID NO: 1355
  REGION 1..1379: note = Description of Unknown:uncultivated organism with predicted taxonomy:Phascolarctobacterium succinatutens
  REGION 1..1379: note = MG18-42 effector

SEQ ID NO: 1395 - protein, 1379 aa, unidentified; identical to SEQ ID NO: 1364
  REGION 1..1379: note = Description of Unknown:uncultivated organism with predicted taxonomy:Phascolarctobacterium succinatutens
  REGION 1..1379: note = MG18-43 effector

SEQ ID NO: 1396 - protein, 1379 aa, unidentified
  REGION 1..1379: note = Description of Unknown:uncultivated organism with predicted taxonomy:Phascolarctobacterium succinatutens
  REGION 1..1379: note = MG18-44 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDEFAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAALKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERLFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSVWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1397 - protein, 1379 aa, unidentified
  REGION 1..1379: note = Description of Unknown:uncultivated organism with predicted taxonomy:Phascolarctobacterium succinatutens
  REGION 1..1379: note = MG18-45 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1398 - protein, 1158 aa, unidentified
  REGION 1..1158: note = Description of Unknown:uncultivated organism with predicted taxonomy:Phascolarctobacterium
  REGION 1..1158: note = MG18-46 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPADVLEKIFKQLFLEKTSKVTKKTLERFFRQENISFQNIGGIDDKINASMKSYNDFKRIFGEDYIQLHREEIENIIRWITLFCDEKKMLVTKIKNTYTQISDDEIKAIKKLKYKDWGRLSATLLNSRAIGYEDKAVGEIITIISALRHTNKNLMELLSNYCPYDFIGEIKDFNGSRQSSNGKLTYKDVEELYVSPSVKRSIWQTLTILEEIKKIMGCESKRIFIEMARSKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANHLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAK

SEQ ID NO: 1399 - protein, 1383 aa, unidentified; identical to SEQ ID NO: 1359
  REGION 1..1383: note = Description of Unknown:uncultivated organism with predicted taxonomy:Phascolarctobacterium
  REGION 1..1383: note = MG18-47 effector

SEQ ID NO: 1400 - protein, 1379 aa, unidentified
  REGION 1..1379: note = Description of Unknown:uncultivated organism with predicted taxonomy:Phascolarctobacterium succinatutens
  REGION 1..1379: note = MG18-48 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLDDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1401 - protein, 1379 aa, unidentified
  REGION 1..1379: note = Description of Unknown:uncultivated organism with predicted taxonomy:Phascolarctobacterium succinatutens
  REGION 1..1379: note = MG18-49 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEHREFFEKLSLANQIHVIGEVLKLFKCASASANLKLLDKGNACGVIKVSNNILKFKQCVLINQSPTGVFEQEVDLMKL

SEQ ID NO: 1402 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-50 effector

SEQ ID NO: 1403 - protein, 1275 aa, unidentified
  REGION 1..1275: note = Description of Unknown:uncultivated organism with predicted taxonomy:Phascolarctobacterium succinatutens
  REGION 1..1275: note = MG18-51 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIILPKIKKYSLFKINGFPMHISGRQLKQLQFYVASQLCIDEYSIAYLKKAFKYENNLAVNDEIIADKNADEEKKQKARKRLDFYEKTWGIGKENNMR

SEQ ID NO: 1404 - protein, 1379 aa, unidentified
  REGION 1..1379: note = Description of Unknown:uncultivated organism with predicted taxonomy:Phascolarctobacterium succinatutens
  REGION 1..1379: note = MG18-52 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWKFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1405 - protein, 1379 aa, unidentified
  REGION 1..1379: note = Description of Unknown:uncultivated organism with predicted taxonomy: Firmicutes
  REGION 1..1379: note = MG18-53 effector
MQKLQNKDYYIGLDMGDASVGWAVTDANYNILKVNGKALWGIRLFDSANTAASTRVFRSGRRRIDRTTWRLKMLQELFADEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKVFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRNTQLGDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLLKINGFPMHISGKTVKQIIFYAAGQLCLADDVADYLKKALKYEVYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1406 - protein, 1379 aa, unidentified
  REGION 1..1379: note = Description of Unknown:uncultivated organism with predicted taxonomy:Phascolarctobacterium
  REGION 1..1379: note = MG18-54 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKNYTDKEFYQQYPTMYHLRYALATQKGHFDVRLLYLAVQHIAKHRGHFLFDNLDASKVNDFNAVFSEVENYVRDEMGIEDWSCQNVDELAKVLCDVNLGRTIKQKAMQSLLPAQTKQQKAIIQLFSGGKAKLAELFLDEELDECEKKSVSFQDDDLDELEPVLTAALGERYEGLLRFKAIYDWNLLAKILHLDAEKKDDSEQHLLSECKVQVYEEHKRDLTVLKSMLKGKPLYNKIFRQDGDISYEKYAKGIKGRNQIDFCKDLKKQLEGIAEYKKIMQEITSIDDAKTEEERLLFRIANGFAFPKQTTKDNGIIPIQVHLAELKCILDNAESYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDNKINASMKSYNDFRRIFGEDYIQLHRDEIENIIRWITLFCDEKKMLATKIRNTYPQISDDKIKAIKKLKYKDWGRLSATLLNSSAIAYEDKGFGELVTIISALRHTNKNFMELLSSYCSYDFIGKIKEYNSGRQNSNSKLTYKDVEELYVSPSVKRSIWQTLTILEEIKKITGHEPKRIFIEMARSKEESKRTDSRLKKLQDLYKQCKEENIDFMPHTDELNAFKIQLSSKKEDDLRSDKLYLYYTQMGRCMYTGERIEIASLYDDNLYDIDHIYPRSKTKDDSLSNRVLVKKEVNAAKTDIYPLDAAIRTKMHTFWKLLYDKGFIDERKYERLIRSKQLRDEELAGFISRQLVETRQSTKAVATILKTAYKHSEIVYVKAGNVSDFRQKFEFVKCRDVNDLHHAKNAYLNIVVGNCYYVKFTAKPLDFIKKNQDNRSYSLKPEIFYKFSIKRDSEIAWVGGKDGTITTVTKTIHKNNILFTRQPVEGKGELFKQNPLKANSGQLPLKAGLSVEKYGGYDSLTTAYFALVKSEGKKGAVQLSIEAIPLVYAKQGENAVQKYLTDVVQLCKPEIKIPKIKKYSLFKINGFPMHIYGRTGNRLVFYGAGQLCISENETVYLKRALKYRDSIEKNENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 1407 - protein, 1379 aa, unidentified
  REGION 1..1379: note = Description of Unknown:uncultivated organism with predicted taxonomy:Phascolarctobacterium
  REGION 1..1379: note = MG18-55 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKMMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISSVKQCILINQSPTGIFEQEVDLMKL

SEQ ID NO: 1408 - protein, 1379 aa, unidentified
  REGION 1..1379: note = Description of Unknown:uncultivated organism with predicted taxonomy:Phascolarctobacterium succinatutens
  REGION 1..1379: note = MG18-56 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1409 - protein, 1379 aa, unidentified
  REGION 1..1379: note = Description of Unknown:uncultivated organism with predicted taxonomy:Phascolarctobacterium succinatutens
  REGION 1..1379: note = MG18-57 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQTGPIDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEEHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEDSAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKDVEELYVSPSVKRSIWQTLTILEEIKKIMGCEPKRIFIEMARSKEESKRTDSRLKKLHDLYKKCREENIDFMPRKDEFNALKTQLSSKKEENLRSDKLYLYYTQMGRCMYTGERIELASLHDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1410 - protein, 1379 aa, unidentified
  REGION 1..1379: note = Description of Unknown:uncultivated organism with predicted taxonomy:Phascolarctobacterium succinatutens
  REGION 1..1379: note = MG18-58 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFFFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCHHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1411 - protein, 1379 aa, unidentified; identical to SEQ ID NO: 1405
  REGION 1..1379: note = Description of Unknown:uncultivated organism with predicted taxonomy:Phascolarctobacterium succinatutens
  REGION 1..1379: note = MG18-59 effector

SEQ ID NO: 1412 - protein, 1345 aa, unidentified
  REGION 1..1345: note = Description of Unknown:uncultivated organism
  REGION 1..1345: note = MG18-60 effector
NGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1413 - protein, 1259 aa, unidentified
  REGION 1..1259: note = Description of Unknown:uncultivated organism with predicted taxonomy:Phascolarctobacterium succinatutens
  REGION 1..1259: note = MG18-61 effector
MLQELFAEEIAKVDPGFFMPLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEKIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCRELNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASA

SEQ ID NO: 1414 - protein, 1379 aa, unidentified
  REGION 1..1379: note = Description of Unknown:uncultivated organism with predicted taxonomy:Phascolarctobacterium succinatutens
  REGION 1..1379: note = MG18-62 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGTQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1415 - protein, 1379 aa, unidentified
  REGION 1..1379: note = Description of Unknown:uncultivated organism
  REGION 1..1379: note = MG18-63 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLCNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKPTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1416 - protein, 1379 aa, unidentified
  REGION 1..1379: note = Description of Unknown:uncultivated organism with predicted taxonomy:Phascolarctobacterium succinatutens
  REGION 1..1379: note = MG18-64 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLQLDDKREKAVYNLFVDKSYTDKEFYQQYPTMYHLRYALATQKGPFDVRLFYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLDEIEPVLTAALGERYEGLLRFKAIYDWSLLAKILHLDAEKKDDSEQHLLSECKVQVYEEHKRDLAVLKSMLKGKPLYNKIFRQDGDISYEKYAKGIKGCNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQYLYKKCREENIDFMPRKDEFNALKTQLSSKKEEDLRSDKLYLYYTQMGRCMYTGESIELASLYDNNLYDIDHIYPRSKTKDDSLSNRVLVQKQVNAAKTDIYPLDAAIRTKMHSFWNLLYDKGFIDERKYERLMRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1417 - protein, 1379 aa, unidentified
  REGION 1..1379: note = Description of Unknown:uncultivated organism with predicted taxonomy: Firmicutes
  REGION 1..1379: note = MG18-65 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQPLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1418 - protein, 1379 aa, unidentified
  REGION 1..1379: note = Description of Unknown:uncultivated organism with predicted taxonomy:Phascolarctobacterium succinatutens
  REGION 1..1379: note = MG18-66 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLCNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYSQISDDEIKAIKKLKYKDWGRLSATLLNSSTIAYEDKAFGELVTIISALRHTNKNFMELLSSYCYYDFIGKIKEFNGSRQSSNGKPTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1419 - protein, 1379 aa, unidentified
  REGION 1..1379: note = Description of Unknown:uncultivated organism
  REGION 1..1379: note = MG18-67 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKNLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTFLEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1420 - protein, 1379 aa, unidentified
  REGION 1..1379: note = Description of Unknown:uncultivated organism with predicted taxonomy:Phascolarctobacterium succinatutens
  REGION 1..1379: note = MG18-68 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYTKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1421 - protein, 1379 aa, unidentified
  REGION 1..1379: note = Description of Unknown:uncultivated organism with predicted taxonomy:Phascolarctobacterium succinatutens
  REGION 1..1379: note = MG18-69 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVSIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1422 - protein, 1379 aa, unidentified; identical to SEQ ID NO: 1360
  REGION 1..1379: note = Description of Unknown:uncultivated organism with predicted taxonomy: Negativicutes
  REGION 1..1379: note = MG18-70 effector

SEQ ID NO: 1423 - protein, 1379 aa, unidentified
  REGION 1..1379: note = Description of Unknown:uncultivated organism with predicted taxonomy:Phascolarctobacterium succinatutens
  REGION 1..1379: note = MG18-71 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1424 - protein, 1379 aa, unidentified
  REGION 1..1379: note = Description of Unknown:uncultivated organism with predicted taxonomy:Phascolarctobacterium succinatutens
  REGION 1..1379: note = MG18-72 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1425 - protein, 1379 aa, unidentified
  REGION 1..1379: note = Description of Unknown:uncultivated organism with predicted taxonomy:Phascolarctobacterium
  REGION 1..1379: note = MG18-73 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1426 - protein, 1379 aa, unidentified
  REGION 1..1379: note = Description of Unknown:uncultivated organism with predicted taxonomy:Phascolarctobacterium succinatutens
  REGION 1..1379: note = MG18-74 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGITEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1427 - protein, 1379 aa, unidentified; identical to SEQ ID NO: 1358
  REGION 1..1379: note = Description of Unknown:uncultivated organism with predicted taxonomy:Phascolarctobacterium
  REGION 1..1379: note = MG18-75 effector

SEQ ID NO: 1428 - protein, 1124 aa, unidentified
  REGION 1..1124: note = Description of Unknown:uncultivated organism with predicted taxonomy:Phascolarctobacterium succinatutens
  REGION 1..1124: note = MG18-76 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGKGELFKQQPLKAKSGQLPLKAGLSVEKYGG

SEQ ID NO: 1429 - protein, 811 aa, unidentified
  REGION 1..811: note = Description of Unknown:uncultivated organism with predicted taxonomy: Clostridiales
  REGION 1..811: note = MG18-77 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQGRKY

SEQ ID NO: 1430 - protein, 1379 aa, unidentified; identical to SEQ ID NO: 1397
  REGION 1..1379: note = Description of Unknown:uncultivated organism with predicted taxonomy:Phascolarctobacterium
  REGION 1..1379: note = MG18-78 effector

SEQ ID NO: 1431 - protein, 1379 aa, unidentified
  REGION 1..1379: note = Description of Unknown:uncultivated organism with predicted taxonomy:Phascolarctobacterium succinatutens
  REGION 1..1379: note = MG18-79 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWKFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKRREENIDFMPRKDEFNALKTQLSSKKEENLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKRGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1432 - protein, 1379 aa, unidentified; identical to SEQ ID NO: 1375
  REGION 1..1379: note = Description of Unknown:uncultivated organism with predicted taxonomy:Phascolarctobacterium succinatutens
  REGION 1..1379: note = MG18-80 effector

SEQ ID NO: 1433 - protein, 1383 aa, unidentified
  REGION 1..1383: note = Description of Unknown:uncultivated organism with predicted taxonomy:Phascolarctobacterium succinatutens
  REGION 1..1383: note = MG18-81 effector
MQNKKNVDYYVGLDMGDASVGWAVTDLNYNILKFNGKALWGIRLFDSAETAAARRGFRSARRRIDRVSWRISMLQELFADEIAKVDAGFFQRLKDSRLQVEDKQEKTAYNLFVGQNYTDKDFYQQYPTMYHLRYALATQAGPFDVRLLYLAVQHIVKHRGHFLFENLDASKVGDFVAVFGEVESYVHDEMELDEWYCHDIDALAKVLCNANLGITAKQKAIQNLLPAKTKQEKAIVQLLSGGKAKLCDLFCDEELAECEKKSISFQEDNLDELEPILEAILQERYEALLRFKAVYDWSLLAKILRLDADKKSENEMHLLSECKVKVYEEHKKDLAVLKSMLKGKPLYNKLFRQDGEDTYANYAQGIKGINQVDFCKSLKKQLESIGEYKKQMQQLTSFEDAQTDVERLLFRVANGLAFPKQTTKDNGIIPIQVHLAELQCILAHAEKYLPFLKNADANGLSVREKITQIVKFRIPYYVGPLAGTRLSREQGRCWVERRAELKNEKIYPWNFDKVVDLEASAENFITNMTAKCTYLVGEDVLPKESLLYSEFMVRNALNNLTIDGERLPVSLLQKIYKQLFLEKTFKVTKKALERFFKQENVSYHDIGGIDDKINASMKAYNDFKRIFGEAYIEMHRDEIENIIRWITLFCDEKKMLETKIRKTYPQIPDDKIKAIKKLKYKDWGRLSATLLDSGKIAYEDASVGERITIISALRHTNKNFMELLSSNCQYDFIGKIKDFNGSKQSDNGKLTYKDVEELYVSPSVKRSIWQTLTILEEIKKIMGCEPKRIFIEMARSKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQLVETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGKGELFKQNPLKAKSGQLPLKAGLSIDKYGGYDSLSTAYFALVESEGKKGAVQFTIEAIPLVYAKQGEATIKKYLTEVVQLCKPEIKVMRIKKYSLLKINGFPMHISGRTGKQLIFYVASQLCIDENSVAYLKKALKYESNLEENEAILADKNADESMKQKAFNRLMFYKDTWGISAEANLQLYDMLLAKSANNLYKNRPASQTATLKEKREQFAKLSLSKQIHVIKEILNLFKCASASADFKLLDKGAACGILKVSNNITKLKQCVLINQSPTGVFEQEVDLMRL

SEQ ID NO: 1434 - protein, 1379 aa, unidentified
  REGION 1..1379: note = Description of Unknown:uncultivated organism with predicted taxonomy:Phascolarctobacterium succinatutens
  REGION 1..1379: note = MG18-82 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELSVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQVGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1435 - protein, 1379 aa, unidentified
  REGION 1..1379: note = Description of Unknown:uncultivated organism with predicted taxonomy:Phascolarctobacterium succinatutens
  REGION 1..1379: note = MG18-83 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEKERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVFPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLIKL

SEQ ID NO: 1436 - protein, 1379 aa, unidentified
  REGION 1..1379: note = Description of Unknown:uncultivated organism with predicted taxonomy:Phascolarctobacterium succinatutens
  REGION 1..1379: note = MG18-84 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRIDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1437 - protein, 1379 aa, unidentified
  REGION 1..1379: note = Description of Unknown:uncultivated organism with predicted taxonomy:Phascolarctobacterium
  REGION 1..1379: note = MG18-85 effector
MQKLQNKDYYIGLDMGDASVGWAVTDANYNILKFNGKALWGIRLFDSANTAASTRVFRSGRRRIDRTTWRLKMLQELFADEIAKVDPGFFMRLEDSRLHLDDKRENAVYNLFVDKNYTDKEFHQQYPTMYHLRYALATKKGPFDIRLLYLAVQHIAKHRGHFLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTGKKEEGEQHLLSECKVQVYEEHKRDLAVLKSMLRGNFLYNKIFRQDGDISYEKYAKGIKGRNQFDFCKDLKKQLECIAEYKKIMQEITSIDAAGTEEERLLFRIANGFAFPKQTTKDNGIIPIQVHLAELKCILDNAEGYLPFLGETDNNSLSVREKIEQIVKFRIPYYVGPLAGTRMSREQGRCWVVRKNEKIYPWNFTEIVNLEESAEKFITNMTAKCTYLFGEDVLPKESLLYSEFMVRNAINNITVDGERLPFDVLEKIFKQLFLAKTSKVTKKTLARFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLAIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKKLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1438 - protein, 1379 aa, unidentified; identical to SEQ ID NO: 1361
  REGION 1..1379: note = Description of Unknown:uncultivated organism with predicted taxonomy:Phascolarctobacterium succinatutens
  REGION 1..1379: note = MG18-86 effector

SEQ ID NO: 1439 - protein, 1379 aa, unidentified
  REGION 1..1379: note = Description of Unknown:uncultivated organism with predicted taxonomy:Phascolarctobacterium succinatutens
  REGION 1..1379: note = MG18-87 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNSEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1440 - protein, 1379 aa, unidentified; identical to SEQ ID NO: 1358
  REGION 1..1379: note = Description of Unknown:uncultivated organism with predicted taxonomy:Phascolarctobacterium
  REGION 1..1379: note = MG18-88 effector

SEQ ID NO: 1441 - protein, 1379 aa, unidentified
  REGION 1..1379: note = Description of Unknown:uncultivated organism with predicted taxonomy: Firmicutes
  REGION 1..1379: note = MG18-89 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSRYCSYDFIGKIKEFNGRRQSSNGKLTYKDVEELYVSPSVKRSIWQTLTILEEIKKIMGCEPKRIFIEMARSKEESKRTDSRLKKLQDLYKKCREENIDFMPRKDEFNVLKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMETVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1442 - protein, 1379 aa, unidentified
  REGION 1..1379: note = Description of Unknown:uncultivated organism with predicted taxonomy:Phascolarctobacterium
  REGION 1..1379: note = MG18-90 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKMMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1443 - protein, 1379 aa, unidentified
  REGION 1..1379: note = Description of Unknown:uncultivated organism with predicted taxonomy:Phascolarctobacterium succinatutens
  REGION 1..1379: note = MG18-91 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGADGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1444 - protein, 1379 aa, unidentified
  REGION 1..1379: note = Description of Unknown:uncultivated organism with predicted taxonomy:Phascolarctobacterium succinatutens
  REGION 1..1379: note = MG18-92 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1445 - protein, 1379 aa, unidentified
  REGION 1..1379: note = Description of Unknown:uncultivated organism
  REGION 1..1379: note = MG18-93 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVEMRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1446 - protein, 1379 aa, unidentified; identical to SEQ ID NO: 1423
  REGION 1..1379: note = Description of Unknown:uncultivated organism with predicted taxonomy:Phascolarctobacterium succinatutens
  REGION 1..1379: note = MG18-94 effector

SEQ ID NO: 1447 - protein, 1363 aa, unidentified
  REGION 1..1363: note = Description of Unknown:uncultivated organism
  REGION 1..1363: note = MG18-95 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNILQVFLNRKWI

SEQ ID NO: 1448 - protein, 1222 aa, unidentified
  REGION 1..1222: note = Description of Unknown:uncultivated organism with predicted taxonomy: Clostridium sp.CAG:964
  REGION 1..1222: note = MG18-96 effector
RTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNN

SEQ ID NO: 1449 - protein, 1379 aa, unidentified; identical to SEQ ID NO: 1397
  REGION 1..1379: note = Description of Unknown:uncultivated organism with predicted taxonomy:Phascolarctobacterium succinatutens
  REGION 1..1379: note = MG18-97 effector

SEQ ID NO: 1450 - protein, 1379 aa, unidentified
  REGION 1..1379: note = Description of Unknown:uncultivated organism with predicted taxonomy:Phascolarctobacterium succinatutens
  REGION 1..1379: note = MG18-98 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKVFYQQYPTMYHLRYALATQAGPFDVRLLYLAVQHIAKHRGHFLFDNLDASKVNNFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEFFYKFNIKRDDDIAWLGGADGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1451 - protein, 1379 aa, unidentified; identical to SEQ ID NO: 1357
  REGION 1..1379: note = Description of Unknown:uncultivated organism with predicted taxonomy: Firmicutes
  REGION 1..1379: note = MG18-99 effector

SEQ ID NO: 1452 - protein, 1379 aa, unidentified
  REGION 1..1379: note = Description of Unknown:uncultivated organism with predicted taxonomy:Phascolarctobacterium succinatutens
  REGION 1..1379: note = MG18-100 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1453 - protein, 1379 aa, unidentified
  REGION 1..1379: note = Description of Unknown:uncultivated organism with predicted taxonomy: Firmicutes
  REGION 1..1379: note = MG18-101 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKIYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPADVLEKIFKQLFLEKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGCCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEKCILINQSPTGVFEQEVDLMKL

SEQ ID NO: 1454 - protein, 1378 aa, unidentified
  REGION 1..1378: note = Description of Unknown:uncultivated organism with predicted taxonomy: Firmicutes
  REGION 1..1378: note = MG18-102 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPVQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHESKRIFIEMARSKEESKRTDSRLKKLQDLYKKCREENIDFMPRKDEFNALKTQLSSKKEDDLRSDKLYLYYTQMGRCMYTGESIELASLYDNNLYDIDHIYPRSKTKDDSLSNRVLVKKQVNAAKTDIYPLDAAIRTKMHSFWKLLYDKGFIDERKYERLMRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1455 - protein, 1379 aa, unidentified
  REGION 1..1379: note = Description of Unknown:uncultivated organism with predicted taxonomy:Phascolarctobacterium succinatutens
  REGION 1..1379: note = MG18-103 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGCTTKQKAMQSLLPVQTKQQKAIIQLFSGSKAKLAELFGDAELDECEKKSVSFQDDDLNEFEPVLTAALGERYEGLLRFKAIYDWSLLAKILHLDAGKKDEGEQHLLSECKVQVYEEHKRDLAVLKSMLKGKPLYNKIFRQDGDISYEKYAKGIKGRNQLDFCKDLKKQLEGITEYKKIMQAITSIDDAKTDEERLLFRIANGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1456 - protein, 1379 aa, unidentified
  REGION 1..1379: note = Description of Unknown:uncultivated organism with predicted taxonomy:Phascolarctobacterium
  REGION 1..1379: note = MG18-104 effector
MQKLKNCDYYIGLDMGDASVGWAVTDTNYNILKFNGKALWGIRLFDSANTAASTRVFRSGRRRIDRTTWRLKMLQELFADEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKNALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1457 - protein, 1379 aa, unidentified; identical to SEQ ID NO: 1452
  REGION 1..1379: note = Description of Unknown:uncultivated organism with predicted taxonomy:Phascolarctobacterium succinatutens
  REGION 1..1379: note = MG18-105 effector

SEQ ID NO: 1458 - protein, 1379 aa, unidentified; identical to SEQ ID NO: 1361
  REGION 1..1379: note = Description of Unknown:uncultivated organism with predicted taxonomy: Firmicutes
  REGION 1..1379: note = MG18-106 effector

SEQ ID NO: 1459 - protein, 1379 aa, unidentified
  REGION 1..1379: note = Description of Unknown:uncultivated organism with predicted taxonomy:Phascolarctobacterium succinatutens
  REGION 1..1379: note = MG18-107 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNAFKTQLSSKKEEDLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSAVVYVKAGNVSDFRQQFKFVKCREVNDLHHAKDAYLNIVVGNCYHVKFTASPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEHEVDLMKL

SEQ ID NO: 1460 - protein, 1379 aa, unidentified
  REGION 1..1379: note = Description of Unknown:uncultivated organism with predicted taxonomy: Ruminococcaceaebacterium
  REGION 1..1379: note = MG18-108 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEQCILINQSPTGVFEQEVDLMKL

SEQ ID NO: 1461 - protein, 1379 aa, unidentified
  REGION 1..1379: note = Description of Unknown:uncultivated organism with predicted taxonomy:Phascolarctobacterium succinatutens
  REGION 1..1379: note = MG18-109 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELVGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1462 - protein, 879 aa, unidentified
  REGION 1..879: note = Description of Unknown:uncultivated organism with predicted taxonomy: Clostridialesbacterium
  REGION 1..879: note = MG18-110 effector
MQKLKNCDYYIGLDMGDASVGWAVTDTNYNILKFNGKALWGIRLFDSANTTASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERLSLIHISEPTRPLYIS

SEQ ID NO: 1463 - protein, 1379 aa, unidentified; identical to SEQ ID NO: 1357
  REGION 1..1379: note = Description of Unknown:uncultivated organism with predicted taxonomy:Phascolarctobacterium succinatutens
  REGION 1..1379: note = MG18-111 effector

SEQ ID NO: 1464 - protein, 1379 aa, unidentified
  REGION 1..1379: note = Description of Unknown:uncultivated organism with predicted taxonomy:Phascolarctobacterium succinatutens
  REGION 1..1379: note = MG18-112 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWVRLSATLLNSSAIAYDDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1465 - protein, 1379 aa, unidentified
  REGION 1..1379: note = Description of Unknown:uncultivated organism with predicted taxonomy: Clostridiales
  REGION 1..1379: note = MG18-113 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLHLDDKRDKAVYNLFVDKNYTDKDFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIGQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLIFYGAGQLCIADDVADYLKKALKYETDIAEKEKTLADQNADEIQKQKAQKGLDFCEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1466 - protein, 1379 aa, unidentified
  REGION 1..1379: note = Description of Unknown:uncultivated organism with predicted taxonomy:Phascolarctobacterium
  REGION 1..1379: note = MG18-114 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQNAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFEQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLAYKDVEELYVSPSGKRSIWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLNDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYQNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1467 - protein, 1379 aa, unidentified
  REGION 1..1379: note = Description of Unknown:uncultivated organism with predicted taxonomy:Phascolarctobacterium succinatutens
  REGION 1..1379: note = MG18-115 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1468 - protein, 1379 aa, unidentified
  REGION 1..1379: note = Description of Unknown:uncultivated organism with predicted taxonomy:Phascolarctobacterium succinatutens
  REGION 1..1379: note = MG18-116 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFNIKRDDDIAWLGGEDGTMATVARTMHKNNILFTRQAVEGKGELFKQNPLKANSGQLPLKAGLSVEKYGGYDSLTTAYFAVVKSEGKKGAVQLSIEGIPLVYARQGEDAIKKYLIEVVHLCNPIIKLNKIKKYSLFKINGFPMHISGRQGKQLIFYVAGQLCLDEESIAYLKKAFKYESDLAINEEIIDDKNAAEENKQKAHKRLDFYENTWGISEVANMQLYDILIAKSANNLYKNRPASQTSTLKQQRDMFAKLPLSKQIRVIKEAMNLFKCASATADFKLLGKGSVCGKIQVSTNITKCKQCILINQSPTGVFEQEVDLMKL

SEQ ID NO: 1469 - protein, 1379 aa, unidentified; identical to SEQ ID NO: 1397
  REGION 1..1379: note = Description of Unknown:uncultivated organism with predicted taxonomy:Phascolarctobacterium
  REGION 1..1379: note = MG18-117 effector

SEQ ID NO: 1470 - protein, 1379 aa, unidentified
  REGION 1..1379: note = Description of Unknown:uncultivated organism with predicted taxonomy:Phascolarctobacterium succinatutens
  REGION 1..1379: note = MG18-118 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKILYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1471 - protein, 1379 aa, unidentified; identical to SEQ ID NO: 1420
  REGION 1..1379: note = Description of Unknown:uncultivated organism with predicted taxonomy:Phascolarctobacterium succinatutens
  REGION 1..1379: note = MG18-119 effector

SEQ ID NO: 1472 - protein, 1379 aa, unidentified; identical to SEQ ID NO: 1421
  REGION 1..1379: note = Description of Unknown:uncultivated organism with predicted taxonomy:Phascolarctobacterium succinatutens
  REGION 1..1379: note = MG18-120 effector

SEQ ID NO: 1473 - protein, 1379 aa, unidentified; identical to SEQ ID NO: 1425
  REGION 1..1379: note = Description of Unknown:uncultivated organism with predicted taxonomy:Phascolarctobacterium succinatutens
  REGION 1..1379: note = MG18-121 effector

SEQ ID NO: 1474 - protein, 1379 aa, unidentified
  REGION 1..1379: note = Description of Unknown:uncultivated organism with predicted taxonomy:Phascolarctobacterium
  REGION 1..1379: note = MG18-122 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1475 - protein, 1379 aa, unidentified
  REGION 1..1379: note = Description of Unknown:uncultivated organism with predicted taxonomy:Phascolarctobacterium succinatutens
  REGION 1..1379: note = MG18-123 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETDIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1476 - protein, 1379 aa, unidentified
  REGION 1..1379: note = Description of Unknown:uncultivated organism with predicted taxonomy:Phascolarctobacterium succinatutens
  REGION 1..1379: note = MG18-124 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLQLDDKREKAAYNLFVDKSYTDKEFYQQYPTMYHLRYALATQKGPFDVRLLYLAVQHIAKHRGHFLFDNLDASKVNDFNAVFSEVENYVRDEMGIEDWSCQNIDEFAKVLRDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILENAEGYLPFLGETDNNGLSVREKIKQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMVRSKEESKRTDSRLKKLQDLYKKCREENIDFMPRKDEFNALKTMLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1477 - protein, 1379 aa, unidentified; identical to SEQ ID NO: 1391
  REGION 1..1379: note = Description of Unknown:uncultivated organism with predicted taxonomy:Phascolarctobacterium
  REGION 1..1379: note = MG18-125 effector

SEQ ID NO: 1478 - protein, 1379 aa, unidentified
  REGION 1..1379: note = Description of Unknown:uncultivated organism with predicted taxonomy:Phascolarctobacterium
  REGION 1..1379: note = MG18-126 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLHLDDKRDKAVYNLFVDKNYTDKDFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLIFYGAGQLCIADDVADYLKKALKYETDIAEKEKTLADQNADEIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1479 - protein, 1379 aa, unidentified; identical to SEQ ID NO: 1436
  REGION 1..1379: note = Description of Unknown:uncultivated organism with predicted taxonomy:Phascolarctobacterium
  REGION 1..1379: note = MG18-127 effector

SEQ ID NO: 1480 - protein, 1379 aa, unidentified
  REGION 1..1379: note = Description of Unknown:uncultivated organism with predicted taxonomy:Phascolarctobacterium
  REGION 1..1379: note = MG18-128 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHEPKRIFIEMARSKEESKRTDSRLKKLQDLYKQCREENIDFMPHTDELNAFKIQLSSKKEDDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1481 - protein, 1379 aa, unidentified
  REGION 1..1379: note = Description of Unknown:uncultivated organism with predicted taxonomy:Phascolarctobacterium succinatutens
  REGION 1..1379: note = MG18-129 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERNEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGITEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLAYKDVEELYVSPSVKRSIWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1482 - protein, 1379 aa, unidentified
  REGION 1..1379: note = Description of Unknown:uncultivated organism with predicted taxonomy:Phascolarctobacterium succinatutens
  REGION 1..1379: note = MG18-130 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRRDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1483 - protein, 1379 aa, unidentified
  REGION 1..1379: note = Description of Unknown:uncultivated organism with predicted taxonomy:Phascolarctobacterium succinatutens
  REGION 1..1379: note = MG18-131 effector
MQKLKNCDYYIGLDMGDASVGWAVTDTNYNILKFNGKALWGIRLFDSANTAASTRVFRSGRRRIDRTTWRLKMLQELFAEEIAKVDTGFFMRLEDSRLQLDDKREKAVYNLFVDKSYTDKEFYQQYPTMYHLRYALATQAGPFDVRLLYLAVQHIAKHRGHFLFDNLDASKVNNFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKNLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1484 - protein, 1379 aa, unidentified
  REGION 1..1379: note = Description of Unknown:uncultivated organism with predicted taxonomy:Phascolarctobacterium succinatutens
  REGION 1..1379: note = MG18-132 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGTVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1485 - protein, 1235 aa, unidentified
  REGION 1..1235: note = Description of Unknown:uncultivated organism with predicted taxonomy:Phascolarctobacterium succinatutens
  REGION 1..1235: note = MG18-133 effector
VRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTISYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1486 - protein, 1348 aa, unidentified
  REGION 1..1348: note = Description of Unknown:uncultivated organism with predicted taxonomy: Clostridiales
  REGION 1..1348: note = MG18-135 effector
MDQNKEYYIGLDGGTDSVGWAVLNPDYTVVKKRGKSLWGVRLFESGQTAAERRLARSARRRTDRRKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEDRFSLLQYAYAAYNWAVFARLLPEGKTISEVKTEEYEAYKADLRALKQLVKQYAPDQYYRVFRSAKIKGNYASYVGKTNCGNEKSNPEPCKPEEFFAFLKKELKPLWSQSIPAAASLAAKLESGTLLRRQRSGENAAIPYQAHLQELQIILKNMQQFYPFLQKADENGFTPAYKIEKLLTFRIPYYVGPLNDAHKEKGFCWIVKKADMPVLPWNFDQVVDESACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVIRKVCALNFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFVEMARGASPEQKNKRTVSRKDQLLALYKACKEDARDWCSELEALPEDKLRSDKLYLYYTQMGRCMYSGELIRLDDLMHDTANQLYDIDHIYPQSKTKDDSLTNRVLVKRQLNAIKSNDYPLPQAMRQTALWKALLEKGLISKQKYLRLTRTTPFTGEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYKLQPLKKGKGQLPLKSSDEHPQPINRYGGYNEVKGAYFVLAAYLKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLFLQGKFLLEKRDVFAALNPEAQVRQLMEILHLFQCNPVAANLSELGGAAHAGILLASKNIDGKVPVSIVHQSVTGYFSQEVCLNDL

SEQ ID NO: 1487 - protein, 1348 aa, unidentified
  REGION 1..1348: note = Description of Unknown:uncultivated organism with predicted taxonomy: Clostridiales
  REGION 1..1348: note = MG18-136 effector
MDQNKEYYIGLDGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWSVFARLLPEGKTISEVKTEEYEAYKADLRALKQLVKQYAPDQYYRVFRSAKIKGNYASYVGKTNCGNEKSNPESCKPEEFFAFLKKELKPLWSQSIPAAASLAAKLESGTLLRRQRSGENAAIPYQAHLQELQIILKNMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASIAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1488 - protein, 913 aa, unidentified
  REGION 1..913: note = Description of Unknown:uncultivated organism with predicted taxonomy: Dorea sp.OM02-2LB
  REGION 1..913: note = MG18-137 effector
NMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1489 - protein, 988 aa, unidentified
  REGION 1..988: note = Description of Unknown:uncultivated organism with predicted taxonomy:Phascolarctobacterium
  REGION 1..988: note = MG18-138 effector
MQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1490 - protein, 1218 aa, unidentified
  REGION 1..1218: note = Description of Unknown:uncultivated organism with predicted taxonomy:Phascolarctobacterium succinatutens
  REGION 1..1218: note = MG18-139 effector
FLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTGKKEEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIISIQVHLAELKFILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDYEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 1491 - protein, 947 aa, unidentified
  REGION 1..947: note = Description of Unknown:uncultivated organism with predicted taxonomy:Phascolarctobacterium succinatutens
  REGION 1..947: note = MG18-140 effector
VHLAELKFILDNAEGYLPFLGETDNNGLSVREKIEQIVKFRIPYYVGSLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDYEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 1492 - protein, 947 aa, unidentified
  REGION 1..947: note = Description of Unknown:uncultivated organism with predicted taxonomy: Firmicutes
  REGION 1..947: note = MG18-141 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1493 - protein, 1056 aa, unidentified
  REGION 1..1056: note = Description of Unknown:uncultivated organism with predicted taxonomy: Clostridium sp.CAG:964
  REGION 1..1056: note = MG18-142 effector
AVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYACLLYT

SEQ ID NO: 1494 - protein, 1348 aa, unidentified; identical to SEQ ID NO: 1486
  REGION 1..1348: note = Description of Unknown:uncultivated organism with predicted taxonomy: Clostridiales
  REGION 1..1348: note = MG18-143 effector

SEQ ID NO: 1495 - protein, 1348 aa, unidentified; identical to SEQ ID NO: 1487
  REGION 1..1348: note = Description of Unknown:uncultivated organism with predicted taxonomy: Firmicutes
  REGION 1..1348: note = MG18-144 effector

SEQ ID NO: 1496 - protein, 951 aa, unidentified
  REGION 1..951: note = Description of Unknown:uncultivated organism with predicted taxonomy: Dorea sp.OM02-2LB
  REGION 1..951: note = MG18-145 effector
GPELVLWVGVILLRRQRSGENAAIPYQAHLQELQIILKNMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1497 - protein, 947 aa, unidentified; identical to SEQ ID NO: 1491
  REGION 1..947: note = Description of Unknown:uncultivated organism with predicted taxonomy:Phascolarctobacterium succinatutens
  REGION 1..947: note = MG18-146 effector

SEQ ID NO: 1498 - protein, 1218 aa, unidentified; identical to SEQ ID NO: 1490
  REGION 1..1218: note = Description of Unknown:uncultivated organism with predicted taxonomy: Firmicutes
  REGION 1..1218: note = MG18-147 effector

SEQ ID NO: 1499 - protein, 1306 aa, unidentified
  REGION 1..1306: note = Description of Unknown:uncultivated organism with predicted taxonomy: Lactobacillusoryzae
  REGION 1..1306: note = MG18-148 effector
LQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1500 - protein, 947 aa, unidentified
  REGION 1..947: note = Description of Unknown:uncultivated organism with predicted taxonomy:Phascolarctobacterium
  REGION 1..947: note = MG18-149 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKISKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1501 - protein, 947 aa, unidentified
  REGION 1..947: note = Description of Unknown:uncultivated organism with predicted taxonomy: Firmicutes
  REGION 1..947: note = MG18-150 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKISKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVNKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1502 - protein, 781 aa, unidentified
  REGION 1..781: note = Description of Unknown:uncultivated organism with predicted taxonomy:Phascolarctobacterium
  REGION 1..781: note = MG18-151 effector
FQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTDISNVKQCILINQSPTGIFEQEVDLMKL

SEQ ID NO: 1503 - protein, 947 aa, unidentified; identical to SEQ ID NO: 1500
  REGION 1..947: note = Description of Unknown:uncultivated organism with predicted taxonomy:Phascolarctobacterium succinatutens
  REGION 1..947: note = MG18-152 effector

SEQ ID NO: 1504 - protein, 1010 aa, unidentified
  REGION 1..1010: note = Description of Unknown:uncultivated organism with predicted taxonomy: Firmicutes
  REGION 1..1010: note = MG18-153 effector
VHCGFFILFFVQVDYTIYHKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1505 - protein, 1056 aa, unidentified
  REGION 1..1056: note = Description of Unknown:uncultivated organism with predicted taxonomy:Phascolarctobacterium succinatutens
  REGION 1..1056: note = MG18-154 effector
VQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1506 - protein, 1046 aa, unidentified
  REGION 1..1046: note = Description of Unknown:uncultivated organism with predicted taxonomy:Phascolarctobacterium succinatutens
  REGION 1..1046: note = MG18-155 effector
LAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1507 - protein, 759 aa, unidentified
  REGION 1..759: note = Description of Unknown:uncultivated organism with predicted taxonomy: Clostridium sp.CAG:964
  REGION 1..759: note = MG18-156 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFK

SEQ ID NO: 1508 - protein, 988 aa, unidentified
  REGION 1..988: note = Description of Unknown:uncultivated organism with predicted taxonomy: Ruminococcaceaebacterium
  REGION 1..988: note = MG18-157 effector
MYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGHWPLKAG

SEQ ID NO: 1509 - protein, 814 aa, unidentified
  REGION 1..814: note = Description of Unknown:uncultivated organism with predicted taxonomy: Clostridium sp.CAG:964
  REGION 1..814: note = MG18-158 effector
FITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASA

SEQ ID NO: 1510 - protein, 767 aa, unidentified
  REGION 1..767: note = Description of Unknown:uncultivated organism with predicted taxonomy:Phascolarctobacterium succinatutens
  REGION 1..767: note = MG18-159 effector
MKSYNDFRRIFGEDYIQLHRDEIENIIRWITLFCDEKKMLVTKIKNTYPQISDDEIKAIKKLKYKDWGRLSTTLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1511 - protein, 815 aa, unidentified
  REGION 1..815: note = Description of Unknown:uncultivated organism with predicted taxonomy: Clostridiales
  REGION 1..815: note = MG18-160 effector
DVLPKQSPLYSRYMVLNELNNIRVDGIRLPVEVKQQAYKDLFLSLPKVSMKKFREYLRTINIQGEISGIDGEFQGSLKPHIDLKRIFGPARNLGAMGEDIIRWIVLFGEAKNILRKKIAEKYDLTEEQMKGVLRLHYSGWGRFSEKFLNGIRDVNKETGEVGDTVIESLWNSSQNLMELLGREHHFLGAISMHNDAFGSSDRITYQTVQDLYVAPAVKRQIWQALTIVKELKGVMGREPKRVFIEMARGPGEKKRTVSRKDALIELYKTLKSDERDWINEIAVQPEDRFRSDRLYFYYLQLGKCLYTGKPIDLDQIYNEMVYDVDHIYPQSKVKDDSLVNRVLVDSTKNKEKSDRYPIDKEIRDRMKPFWKMLLQQGFMEKEKYERLTRSTPFSDNELAEFIARQLVETRQSTKAVAEILQQVYPLSKIVYVKAGLVADFRRYMGHVKCREVNDYHHAKDAYLNIVAGNIYHTRFTDNPYNFIKEAKDKDQKYSLKLEKLLTRDIRRGDITAWDTTGNKTRGVVEKVLARNDIRFTRYPYTEKGQLFDVTLMKKGLGQLPIKANLPIEKYGGYNKVKGAYFMLVEHTDKKGKRIRTLKDVPVHLASQLATDVKKQEYCLDLGMKDPVIRYSKIKMKSLVEVDGFRMHISGRKGDALVLSHAHELVIGEYWEQYIKKLVKFRERAQAFSKSNRGMNLKITTYDGIDGNNNMELYDLFVSKLNNTIYQLKLSKQGTDLLDERERFLNLTIEEQVGILLEILNFFKCNRTSSDLKLLGKGGQAGNLSINSTISGYQTFKLINQSPTGVFEESVDLLKV

SEQ ID NO: 1512 - protein, 1098 aa, unidentified
  REGION 1..1098: note = Description of Unknown:uncultivated organism with predicted taxonomy: Firmicutes
  REGION 1..1098: note = MG21-1 effector
MTSHSIRYTLGLDIGIASVGWAVLRNGSDSEPYRIETLGVRIFDKAEVPKTGASLAAPRREARSSRRVVRRRRHRKERIKYLIEQEGIMTQAEMTRLFQNSSFEKSVYEIRVEALDRMLTREETVRLLIHFAQRRGYKSNSKAEEAKDNENGVIKQAISQNKQAMKAHGYRTFGEMLLMDERFYYTQPDGSRIFIPHNKASDYKVTAERSMLADELHMIFAAQRSLGSLWFSDTFETAYMDVWSSQRSFDEGPGGDSPYGGSQIEKMLGTSSDGESRAPKASYSAEYFRLLQDVNHLRIVSLDGTSSPLTQEQRDIVVAASKKSGTLTYTQLRKKLALADDQYFNALYYGDKTAVEVEKKRFGHLQFYHQLRTALDTVEKGAADTLTWAQRDEIARILTVYKADVRRTDELRKAGIPAEYIRALLPLSPTRAMHLSVTAIRKMIPHLEAGMSYSDAYSKAYGNQSTASAAPKKNKLSLNDIEEITNPVVRRAVSQSIKVINAIVRQYGAPERVRIELAREMGKNFKDRGKIAKSQADHAAKNERIKAQISEYKSDHITGQDIVKFKLFKEQDGICLYSGKSLDIARLFEPGYVDVDHIIPYSISFDDSYNNKVLVLSSENRQKGNRIPYAYFGQNSDRWEKYETLVSNTVRSYRKRKNLLLKSLSEAQIDGFKQRNLQDTQYLSKVIFRLIENHLQFAETAPGKKHTQPVNGAITAQVRKRLGIEKIREDGDLHHAVDAAVIACITPGMIQKITKYAQNHERFYATAKGYVDIETGEVLTRSEYEAMDDIRFPEPWPGFRSELEARVSEHPQEAIARLKLPHYENSEEIRPIFVSRMPNHKVTGAAHLETIRSKKGGAGSTVTKTALPDLKLDKNGEIAGYYRKEDDPLLYEALKARLKAFGGDGKKAFAEPFHKPKHNGEPGPIVKKVKIQESATLTVPVNHGIAANGSMVRLDVFHVDGDGYYFVPIYTSDTVKPELPNRAVVAGRRVQEWKVMDDSYFKFSLYPKDLIRIRSKKGIKLKAVNRNADLQEYSTNDCLCYFVKFNISTGALSVENHDRKFEQPGLGGKTLLSIEKYQVDVLGNYSPVALPEKRMKFR

SEQ ID NO: 1513 - protein, 915 aa, unidentified
  REGION 1..915: note = Description of Unknown:uncultivated organism with predicted taxonomy: Roseburia sp.AM23-20
  REGION 1..915: note = MG21-3 effector
HNTSGVYDLTVARTFIEEEAHKLFAAQRQFGNAFATENIENEYCEILLSQRHFSDGPGGERTFKFDLRGNCTFEKDELRAFKACYTFEFFKLLQDINHLRIIPEYRKGSNKQTRPLTPEERQKIIDLCLKSSSIDFSKLRKELKLADDEIFNRVGYDVKKKKSKKKDAEEQPEEQLTPEQQRTKCEEATKFTQMQSYHEMRKALDKVAKGTISKFSHDKLDEIGEILSLYKADDKRRERLEQIGLSNEEIEALLPLTFTKAGNLSLGAMRKLIPYLEQGLTYDKACEIVYGDHRAQYKGERMPLLSFGKLKEEGALDSVNNPVVLRAIAQTFKVVNAIIRRYGSPQAIHIELARDMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNLTDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRKISGQAHAETIRSARIDVDESGKERIIAVAKTPLTSLKLDKDGEIDGYYMPSSDRLLYEELKNRLIKTKTSGKTYGNAEQAFKEPVYKPKKDGSQGPRVYKVKTWKPTTSNVKVAGGIAKKGDIVRVDIFHITGGKDQGYYFVPIYVADTIKNTLPKHAVVTNFKSSKVEWKEMDDSNFIFSLYKGDLIHIELCADCRDKDSNNKIRKAKDMYVYYDG

SEQ ID NO: 1514 - protein, 1166 aa, unidentified
  REGION 1..1166: note = Description of Unknown:uncultivated organism with predicted taxonomy: Clostridiales
  REGION 1..1166: note = MG21-4 effector
MHYILGLDIGITSIGWAVIESDQDGAPFKIADLGVRIFKAAEQPKTGSSLALPRRSARSLRRRLWRKAHRKERIKLLLDRVGLITKENLEKLFSASSFEKDVYTLRSEGLDRKLNNEEWARVLYHLAQRRGYRSSSKAEEADTKNDAGKLLKAVKNNSDKMAQNNFRTVGEMFCKDSSDLFQVKDGSGHVIGRKTHNTSGVYDLTVARTFIEEEAHKLFAAQRQFGNAFATENIENEYCEILLSQRHFSDGPGGERTFKFDLRGNCTFEKDELRAFKACYTFEFFKLLQDINHLRIIPEYRKGSNKQTRPLTPEERQKIIDLCLKSSSIDFSKLRKELKLADDEIFNRVGYDVKKKKSKKKDAEEQPEEQLTPEQQRTKCEEATKFTQMQSYHEMRKALDKVAKGTISKFSHDKLDEIGEILSLYKADDKRRERLEQIGLSNEEIEALLPLTFTKAGNLSLGAMRKLIPYLEQGLTYDKACEIVYGDHRAQYKGERMPLLSFGKLKEEGALDSVNNPVVLRAIAQTFKVVNAIIRRYGSPQAIHIELARDMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNLTDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRKISGQAHAETIRSARIDVDESGKERIIAVAKTPLTSLKLDKDGEIDGYYMPSSDRLLYEELKNRLKAYGNAEQAFKEPVYKPKKDGSQGPRVYKVKTYKTTTSNVKVAGGIADNGSMVRIDVFHIKEGKDKGYYFIPIYVADTIKQKLPQKAVVAAKSIDQWKEMDDEDFIFSLYPGDLVRVEHKKDIVFKSTDKNSSDTISCKNLLTYYSGANISTGAITITNHDRSYIVHGLGIKTLQLLEKYEVDVLGNYHKVRLPEKRQAFNLKYSQKKQ

SEQ ID NO: 1515 - protein, 1166 aa, unidentified; identical to SEQ ID NO: 1514
  REGION 1..1166: note = Description of Unknown:uncultivated organism
  REGION 1..1166: note = MG21-5 effector

SEQ ID NO: 1516 - protein, 1166 aa, unidentified; identical to SEQ ID NO: 1514
  REGION 1..1166: note = Description of Unknown:uncultivated organism
  REGION 1..1166: note = MG21-6 effector

SEQ ID NO: 1517 - protein, 1136 aa, unidentified
  REGION 1..1136: note = Description of Unknown:uncultivated organism with predicted taxonomy: Clostridium sp.CAG:571
  REGION 1..1136: note = MG21-7 effector
MGYRIGLDIGITSVGWSVIEDDSNGNPIRIIDLGSRIFDAAEKPKDGSPLAKERRDARGLRRRLRRKKYRVERTKRLLERYDIITKKEVDEMYANKAHVKHLYNVYELRVLGIEQKLTNKELARVLISLVKKRGYKSNSKAEESNGEAGKLLTATRDNELLMQSKGYRTVAEMYLKDDKFKAKDKNGEILVDKDGSPLLKIKNSTGDYKNTTLRKLLVEEIKLILNKQKELNSKITDDFINEYLKIFESQRNFDDGPGFPSPYGGNLIENMLGNCTFEKEEKRAPKATYTFEYFKFLQTLNHIKIETINKKDDGTINKEKRELTSEEKEKLKELVFSKVTVTYSDVRKTLQLESNQRFNMFTYRDLLNYTEETNKEIEKEKKLKEFESYKKIKTALNHIEKNYITKLTTDDLDEIGYALTVYKSNDKRKEYLEKHTPNLSKEAIEELLKLSFSKVGNLSLKAMKKIIPELEKGVTYDKAVDKVYEDFRGTVDTQKKRKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNLNDTKYICKYMYNLIRNHLEFSDNANFVRKVWTVNGKLTAHIRKRLGIEKVRDGDTHHAVDATVIAITTQNMINRLTRYYQYVDGRYMNNKGEYIDTYTGEIINAKEYEEKYGIYFPEPWPKFRKELDIRTNCKTRERMIECLEAEKIYTYEDYDDVEPIFVSRMPRRKVTGTAHLDTIRGIKEKDGELKTITKTELTKLKLKDGEIEGYPENCKRDDRLLYEALKNRLIEFNGDATKAFSEPFYKPKSDGTRGPVVNKVKIEANTTMGVKLNDNKAFAANGDCVRLDIFYVENEGYYFIPIYVSDTVKKELPNKACVAGKKYADWKEMRDENFIFSIYPKDLIYIQGKNKIKLNPVIKDKDSIEVEEILAYYVKAGISVAQIAIQTNDNKYNQSSLGIKNLKKLEKYEVDILGNYHKVKLPEKRLPFNINKK

SEQ ID NO: 1518 - protein, 1121 aa, unidentified
  REGION 1..1121: note = Description of Unknown:uncultivated organism with predicted taxonomy: Clostridiales
  REGION 1..1121: note = MG21-8 effector
MGGNAMKKEQKHCHYTLGLDIGIASIGWAVLGNNEDGTPNRIIDLGVRIFESAEVQKTGESLAAPRRDARSARRRLRRHRHRLERIRYLLVQQGVLTQEEMTHLYDKSDMVSPYQLRTEGLDRLLNAREFSKVLIHLAQRRGYQSNSTAEEAKNEKENGIIKTAILENQQRMGRGGYRTIGEMMYRDAAFWETINGIRYHCTRNKAGDYRFTVDRASILAEVSILFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGISDEVRFAGLYYGEDTIEKAEKRKWPQMQSYHKIRTALDKVSKDAIQTLTQDQLDAIGEILAGGVSDAKRINSFCLAGIPEEYHKALLPLSISKRAKLSIAAMRKLIPFLQQGMRYDEACKAAGLDFHGADGKVEKLSDFLNEITNPVVRRAVSQTIKVVKAVVDTYSNRKEMKLDAVRIELAREMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNLNDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHTVTGAAHKETIRGKTETGTAVKTALTSLKLDKNGEIDGYYNPQTDPRLYQALVERLKKFGGDGAKAFAEPFYKPKRDGTPGPRVDKVKIAEKASLSVPTGRGEADNGEMIRIDVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 1519 - protein, 1093 aa, unidentified
  REGION 1..1093: note = Description of Unknown:uncultivated organism
  REGION 1..1093: note = MG21-9 effector
MHYILGLDIGITSIGWAVIESDQDGKPFKIADLGVRIFKAAEQPKTGASLALPRRSARSLRRRLWRKAHRKERIKLLLDKVGLISKENLEKLFSASSFEKDVYTLRSEGLDRKLNNKEWARVLYHLAQRRGYRSSSKAEEADTKNDAGKLLKAVKNNSDKMAQNNFRTVGEMFCKDSSDLFQVKDGSGHVIGRKTHNTSGVYDLTVARIFIEEEAHKLFAAQRQFGNAFATESIENEYCEILLSQRHFSDGPGGERTFKFDLRGNCTFEKDELRAFKACYTFEFFKLLQDINHLRIIPEYRKGSNKQTRSLTPEERQKIIDLCLKSPDVKFSKLRKELKLEDDELFNRVNYDVKKKKSKKKDAEEQPEEQLTPEQQRTKCEEAAKFTQMQSYHEMRKALDKVAKGTISKFSHDKLDEIGEILSLYKADDKRRERLEQIGLSNEEIEGIGGKLFVLTGNLSLIAMRKLIPYLEQGLTYDKACEIVYSDHRAQYKGERMPLLSFGKLKEEGALDSVNNPVVLRAIAQTFKVVNAIIRRYGSPQAIHIELARDMKRNFTDRQDIKKKQDSNWSYNDKIREKVEELKGSAATGQDIVKMKLYEEQDGYCLYSGKQLDIRRLFEVGYAEVDHIVPYSKCFDDSYNNKVLVFSSENQRKGNRLPLEYMLAEGDEDKLDDYVTLVEARIKNTRKKQRLLKPCLTAEDSNDWKERNLTDTQYITKAVADILRNYLAFEEDSPFIKKPVRSINGAVTDQVRKRLGLQKHREEGDLHHAMDAAVIAVTTDGYINRISRYTQRREFGKRIGCYVDLETGEKLTKQAFEQKYEPTFPAPWNKFTKELKARMAPNADEAIRQLYLPSYGSEEIKPIFVSQMPDRKVSGQAHAETIRSARIDVDGNGKERIIAVAKTPLTSLKLDKDGEIDGYYMPSSDRLLYEELKNRLKAYGNAEQAFKEPVYKPKKDGSQGPRVYKVKTWKTTTSNVKVAGGIADNGSMVRIDVFHIKEGKDKGYYFVPIYVADTIKKELPQKAVVAAKPIDHWKEMDDKDFIFSLYPGDLIRVEHKKDIVFKSTDKNSSDTISCKNLLTYYVFANISTGAIAI

SEQ ID NO: 1520 - protein, 1136 aa, unidentified
  REGION 1..1136: note = Description of Unknown:uncultivated organism with predicted taxonomy: Clostridiales
  REGION 1..1136: note = MG21-10 effector
MGYRIGLDIGITSVGWSVIEDDSNGNPIRIIDLGSRIFDAAEKPKDGSPLAKERRDARGLRRRLRRKKHRIERTKRLLERYDIITKKEIDEMYANQAHVKHLYNVYELRVLGIEQRLTNKELARVLISLVKKRGYKSNSKAEESNGEAGKLLTATRENEILMQSKGYRTVAEMYLKDDKFKAKNKKGEILVDKDGTPLLKIKNSTGDYKNTTLRKLLIEEIKLILNKQKELNSKITDDFITEYLKIFESQRNFDDGPGFPSPYGGNLIENMLGNCTFEKEEKRAPKATYTFEYFKFLQTLNHIKIETINIKDDGTINKEKRELRSEEKEKLKELVFSKVTVTYSDVRKTLQLEPNQRFNMFTYRDLLNYTEETNKEIEKEKKLKEFESYKKIKTALNHIEKNYITKLTTDELDEIGYAVTVYKNDDKRKEYLENHTTNLSKEAIEELLNLSFSKVGNLSLKAMKKIIPELEKGVTYDKAVDKVYEDFRGTVNTQKKRKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNVEEYEIRVNTLIRNNKKKQNLLRQDFTREDAEDWKERNLNDTKYICKYMYNLIRNHLEFSDNPNFVRKVWTVNGKLTAHIRKRLGIEKVRDGDTHHAVDATVIAITTQNMINRLTRYYQYVDGRYMNNKGEYIDIYTGEIINAKEYEEKNGIYFPEPWPKFRKELDIRTNCKTRERMIECLEAEKIYTYEDYDDVEPIFVSRMPRRKVTGTAHLDTIRGIKEKDGELKTITKTELTKLKLKDGEIEGYPDNCKRDDRLLYEALKNRLVEFNGDAAKAFSEPFYKPKSDGTRGPIVNKVKIEANTTMGVTLNDGKAFAANGDCVRLDIFYVENEGYYFIPIYVSDTVKKELPNKACVAGKKYADWKEMKEKDFIFSIYPKDLLYIQGKNKIKLNPVVKDKDPIEVEEILAYYLKIDISTATIEIKSNENKYVKRGLGGKGLKKLEKYEVDILGNYHKVKLPEKRLPFNINKK

SEQ ID NO: 1521 - protein, 1136 aa, unidentified
  REGION 1..1136: note = Description of Unknown:uncultivated organism with predicted taxonomy: Clostridiales
  REGION 1..1136: note = MG21-11 effector
MGYRIGLDIGITSVGWSVIEDDSKGNPIRIIDLGSRIFDAAENPQDGSALAKERRDARGLRRRLRRKKHRIERTKRLLERYDIITKKEIDEMYANQAHVKHLYNVYELRVLGIEQRLTNKELARVLISLVKKRGYKSNSKAEESNGEAGKLLTATRDNEILMQSKGYRTVAEMYLKDDKFKAKDKNEEILVDKDGIPLLKIKNSTGDYKNTTLRKLLIEEIKLILNKQKELNSKITDDFITEYLKIFESQRNFDDGPGFPSPYGGNLIENMLGNCTFEKEEKRAPKATYTFEYFKFLQTLNHIKIETINIKDDGTIKKEKRELTSDEKEKLKELVFSKVTVTYSDVRKTLQLEPNQRFNMFTYKDLLNYTEETNKEIEKEKKLKEFESYKKIKTALNHIEKNYITKLTTDELDEIGYALTVYKNDDKRKEYLENHTTNLSKEAIEELLKLSFSKVGNLSLKAMKKIIPELEKGVTYDKAVDKVYEDFRGTVNTQKKSKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDSEDWKERNLNDTKYICKYMYNLIRNHLEFSDNTNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECIEAERIYTYEDYNDVEPIFVSRMPRRKVTGPAHVATIRGVKEKDGELKKITKTELTKLKLKDGEIEGYPENCKRDDRLLYEALKNRLIEFNGDATQAFSEPFYKPKSDGTRGPVVNKVKIEANTTMGVILNDKKAFAANGDCVRLDVFYVENEGYYFIPIYVSDTVKKELPNKACVAGKKYADWKEMKDEDFIFSIYPKDLIYIQGKNKIKLNPVIKDKEPIEVEEIFAYYVKAGISSAAITIQTNDSKYVQPSLGIKSLKKLEKYEVDILGNYHKVKLPEKRLPFNINKK

SEQ ID NO: 1522 - protein, 1088 aa, unidentified
  REGION 1..1088: note = Description of Unknown:uncultivated organism with predicted taxonomy: Helicobactersp. MIT 11-5569
  REGION 1..1088: note = MG21-12 effector
MHYILGLDIGITSIGWAVIESDQDGVPFKIADLGVRIFKAAEQPKTGASLALPRRSARSLRRRLWRKAHRKERIKFLLDKVGLISKENLEELFLASGFEKDVYTLRAEGLDRKLNNEEWARVLYHLSQRRGYKSSSKAEESDKDNKEAGKLLNAVKSNSDKMKQNNFRTVGEMFCKDNSDLFQVKDGSGHIVGRKTHNTSGVYDLTIARNLIEAEVHKLFAAQRQLGNAFATESIENEYCEILLSQRHFSDGPGGERTFKFDLRGNCTFEKDELRAFKACYTFEYFKLLQDINHLRIIPEYRKGSAKQTRPLTPEERQKIIDLCLKSPSIDFSKLRKELKLADNELFNRVNYDVKKKKGKKKDTEEQSEEQLTPEQQRLKCEKAAKFQQMQSYHEICKALDKVAKGTISKLSHDQLDAIGEALSLYKADDKRRERLEQIVLSNEEIEALLPLDSTKAGNLSLIAMRKLIPYLEQGLTYDKACEQVYGDHRAQYNGERMPLLSFGNLKEEGALDSVNNPVVLRAIAQTFKVVNAIIRRYDSPQAIHIELARDMKRNFADRQDIKKKQDNNWSCNDRIRQKVEEYKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNLTDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPDRKISGQAHAETIRSARVDVDESGKERIIAVAKTPLTSLKLDKDGEIENYYMPSSDRLLYEELKNRLKAYNNDPKEAFKEPVYKPKKDGSQGPRVYKVKTWKTTTSNVKVAGGIADNGSMVRIDVFYVKEGKDKGYYFIPIYVADTIKKELPQKAVVQGESMNNWKEMDDKDFIFSLYPGDLVRVEHKKNIEIGRAS

SEQ ID NO: 1523 - protein, 1132 aa, unidentified
  REGION 1..1132: note = Description of Unknown:uncultivated organism with predicted taxonomy: Clostridium
  REGION 1..1132: note = MG21-13 effector
MGYRIGLDIGITSVGWAAIEDDANGNPKRIIDLGSRIFEAAEKPKDGSPLAKDRRDARGLRRRLRRKKHRVERTKRLLERYNIITKKELEDLYENYRFQYNVYELRVMALDEKITNKDLARILISMVKKRGYKSNSKSEEIASGSDAGKLLTATKENEELMKEKGYRTVAEMYLKDDKFKLKNSNGEYILYKKGRKQIKIRNSINEYKNTALRKLLVDEIKLILEKQRELNSSINDNFIKEYLEIFESQRSFDEGPGEPSPYGGNQIEKMLGNCTFEKEEKRAAKASYTFEYFKLLQDINHIKINKYDLETRKIEKRELTEEERQKIIKIVKEKANVTYSSLRKELNLSRTERFNMLSYKNILMWSDETNEEVEKTAKFKEFESYNKIKTALNRVEKGYIEKLTTEELDKIGYALTVYKNDDKRIAYLKENTQNLTEEAIQELLKLSFTKVGNLSIKAMKKIIPELEKGITYDKAVDNVYEDFRGIVNTEKKRKLRLQDLEQEISNPVVRRGISQAIKVLNAITLRYNEKYGKPDVVVIELSREMGKNFNDRSKIKKSQEENMQRNENIRQAIIELGKSNPTGQDIVKYKLWQEQDNFCVYSGKKITVDMLFTEAVDVDHIIPYSMCFDDTYNNKVLVLASENRQKGNRVPYKYEKEIGRNIDEYVVRVGNIIKNPKKLRRLLREDFTKEDAKDWKNRNIQDTQYMCKLMYNLVRNHLEFSDNKNFERKVWTVNGSVTAHIRKRLGIEKTRDGDTHHAVDAAVIAITTQNMINRITKYYQYNDGKYMNNKGEYIDLETGEILDAKEYEAKNGIYFPEPWPKFRKELDIRVNCNSKERMIECLNAEKIFTYEDYEDVEPIFVSRMPRRKVTGMAHLETIRGLREENGSLKTITKTELAKLKLDKSGEIEGYPEKNKKDDKLLYDALKEQLTKFGGDGKVAFKKDFYKPRADGNKGPIVRKVQIEANATLGVTLKDREGFAGNGDCVRLDIFYVEGEGYYFVPIYVSDTIKEKLPNKACVQGKKYEEWKEMREEDFIFSLYPKDLIYVKGKNKIKLNATNKSGEQIEVEDTMAYYINAGISVAQITIQTHDNKYEQPSLGIKSLKELKKYEVDVLGNYHEVKIPEKRMPFNIKK

SEQ ID NO: 1524 - protein, 1169 aa, unidentified
  REGION 1..1169: note = Description of Unknown:uncultivated organism with predicted taxonomy: Clostridiales
  REGION 1..1169: note = MG21-14 effector
MGYRIGLDLGISSIGWACVEDKENGEPKRIIDLGTRIFDRAENPKDGAPLAAPRREARELRRRLRRRNHRIKRTKILLEKYDIISQQEIEKMYENYNFPNTPYELRVIGLDNKLTNKELARVLISLVKKRGYKSNSKSEESNDKETGKLLTATKDNENLMKEKGYRSVAEMYLKDEKFKMRLPNGQIATRIDKNTGKEIEIIKIKNSINDYKNTPLRKLLVEEIKLILNKQKEYNPKITDQFINEYLNIFTSQRNFDEGPGEPSPYAGNQIEKMLGKCTFEREEYRAPKSTYTFEYFKLLQDLNHIKIIKYELKQDNEIVQTVRTLTEEERKKLIELAKKTPTLNYYKIRKEIKLKENERFNMCRYKSTREFTDDVNKEAENDNKKIKEFQSYHEIRKALDKYKKEYIQELSTNDLDSIGYALCVYKNDKKRIEYIKTNVTQIPDEVINYLLPLSFSKVGNLSLKAMKKIIPYLEKGLTYDKAVNELGKIDSNYSDFRGVVNTEKRRKLSINNLEDNISNPVVRRAVSQTIKVLNAITLKYNSIYGKPDLVVVELARELGKSFKERQSIEKIYEENRTRNEKAIQEIRELGKTNVTGKDIVKYKLWKDQNEICIYSGKHIKVEDLFTDAVDIDHIIPYSQCFDDTYKNKVLVLASENRQKGNRTAYKYIKEAGKNLEEYEVRVNNYIKDYRKKERLLKADFSTEDAKNWKDRNIEDTQYISRLVYKLINNYMEFSDNPNVNRKVRNINGAVTHYIRNRLGIEKIRADGDEHHAVDACIIATTSNYMVNKITRYSQYIDGRFMNDRGEYIDIETGEIINKEEYEEEYGPKFPEPWEGFRRELEIRSSDDVANRAEKTPEELKNIMIQEINDEIKNGKLYSYIEHDDGINRFDDIEPIFVSRMPRRKVKGQAHMETIRGIEKENGKLKTVTKTPLTKLKLDDNNEIKNYSKKAKQDDKLLYDALVEQLKKFNGKGEEAFKEPFFKPKKDGSKGPIVNTVKIEENATLGVEFKEGKAFAGNGNMVRIDVFYVEGEGYYFIPIYVADTIKKELPNKACVANKGTDKWKTMDDKNFIFSLYPNDLIYIESEKGIKLNGNNDNKKEQIEVKKLFAYYVKAGISTAAITIDNQDGEYTQPGLGIKGLKKIEKYDIDVLGNYHKIKLPEKRIKFNIN

SEQ ID NO: 1525 - protein, 1133 aa, unidentified
  REGION 1..1133: note = Description of Unknown:uncultivated organism
  REGION 1..1133: note = MG21-15 effector
MGYRIGLDIGITSVGWAVIEDDIEGKPKRIIDLGSRIFDAAENPKDGSALAKVRRDARGIRRRGRRKKHRIERTLHLLERHHIISKKEWISMFENYNFQFNIYELRVKALEEKITNKDLARILVNFVKKRGYKSNSKSEENDSSNDAGKLLTATKENQNIMQEKGYRTIGELYLKDDRFKLKDKNGDYILDKNGQKIMKVRNTTNDYKGTALRTLISDEIKLILNKQKEYTSLITDEFIQEYISIFESQRNFDEGPGEPSPYAGNQIEKMLGFCTFEKEERRAPKATYTFEYFKLLQDINHIKIEKLSLDDNMQRVKSKRSLVKDEKEKIIELVKSKTKISYYDIRKALNLQENERFNMFTYKNVLLWNNETNAEVEKDKIFKEFESYNKIKTALNRIEKNYILKLNTDELDYIGYALTVYKNDEKRISFLKENTSLPDRIINELLNLSFTKVGNLSLKSMKKIIPYLENGLTYDKAVNSVYEDFRGEINTEKKQKLRLKDLEEDISNPVVRRGISQAIKVLNAITLRYNAKYGKPDVVVIELAREMGRNFKDRNIIKKSQEINMKNNEFVKERIVELGKENPRGQDIVKYKLWQEQDGVCIYSGKKIPIENLFTEAVDVDHIIPYSMCFDDTYNNKVLVLASENRQKGNRVPYKYEKEIGRDIEEYEVRVNNIIKNPYKRVKLLREDFTREDALEWKDRNIQDTQYICKLMYNLVKNHLEFSNNKNFDRKVWTVNGAITSHIRKRLGIEKTRDGDIHHAIDAVVIAITTQEMINKLTKYYQYKDGKYMNNKGEFIDLETGEILDAEKYEKENGIYFPEPWPKFRKELEIRTICPTKETMISYLHNEKIFTYDDYEDVEPIFVSRMPKRKITGTAHLETVRGFEKRDNEIYTITKTELKKLKLDKDGEIEGYPEKNKRDDRLLYDALREQLKRYNNDGEKAFKDDFYKPRKDGSRGPLVKKVQIESKTTLGVELKNKGFAANGDSVRIDVFYIEGDGYYFIPIYVSDTIKKELPNRACVPNKTYSEWKEMDEKNFIFSLYPKDLLYIKGKNKIKLNPTNKIDEPIEVEETMAYYVKAGISVASITIQTHDNKYQQPNLGIKTLKKLKKYEVDVLGNYHEVKLPEKRMPFNIKK

SEQ ID NO: 1526 - protein, 1166 aa, unidentified
  REGION 1..1166: note = Description of Unknown:uncultivated organism
  REGION 1..1166: note = MG21-16 effector
MHYILGLDIGITSIGWAVIESDQDGVPFKIADLGVRIFKAAEQPKTGASLALPRRSARSLRRRLWRKAHRKERIKLLLDKVGLISKKNLEKLFSASSFEKDVYTLRAEGLDRKLNNEEWARVLYHLAQRRGYRSSSKAEEADKDNKEAGKLLNAVKSNSDKMKQNNFRTVGEMFCKDNSDLFQVKDGSGHIVGRKTHNTSGVYDLTIARNLIEAEVHKLFAAQRQLGNAFATESIENEYCEILLSQRHFSDGPGGERTFKFDLRGNCTFEKDELRAFKACYTFEYFKLLQDINHLRIIPEYRKGSAKQIRPLTPEERQKIIDLCLKSPGLDFSKLRKELKLEDDELFNRVSYDVKKKKGKKKDTEEQSEEQLTPEQQRLKCEKAAKFQQMQSYHEMRVALDKVAKGTISKLSHDQLDGIGEVLSLYKADDKRRERLEQIGLSNEEIEALLPLKFTKAGNLSLTAMRKLIPYLEQGLTYDKACEIVYSDHRAQYNGERMPLLSFGKLKEEGALDSVNNPVVLRAIAQTFKVVNAIIRRYSSPQAIHIELARDMKRNFTDRQDIKKKQDNNWSYNDRIRQKVEELKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNLTDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPNRKVSGQAHAETIRSARVDVDESGKERIIAVAKTPLASLKLDKDGEIENYYMPSSDRLLYEELKNRLKAYDSAEQAFKEPVYKPKKDGNRGPRVYKVKTWKKTTSNVKVAGGIADNGSMVRIDVFYVKGEGYYFIPIYVADTIKKELPQKAVVDKSVAVKHGWKEMNDKDFIFSLYPGDLIRVEHKSQIVLKSTQKNSKDTKVGKEFFLYYKSANISNGAIDASYHDQSYEKEGLGIKTLQSFEKYEVDVLGNYHKVHLPEKRQAFNLKYSQKEQ

SEQ ID NO: 1527 - protein, 1100 aa, unidentified
  REGION 1..1100: note = Description of Unknown:uncultivated organism with predicted taxonomy: Clostridiales
  REGION 1..1100: note = MG21-17 effector
MSDFHYALGLDIGIGSVGWAVLRNQPNGEPDRIQDLGVRIFDKAEQPKTGASLAAPRRDARSARRRLRRHRHRLERIRYLMEQHDIMSVSDIQAMYTAGGFKKSPYQLRAEALDRPLSKEETVRVLIHLAQRRGYKSNSMAEAAKDEKETGKVKSAIEENRACMEQHGYRTVGEMMFRDERFWQNNPDGTRYHKTRNKVEDYRFTVERSDIVNEAKQIFAAQRQFGTGWLDDGMETAYLSILESQRSFDEGPGGDSPFRGGIGERVGSCTFEPDEQRAAKATYTFEYFKLLQDLNHMRLAGNGMAPRPLTAQQREILKAAALQSASLSYGQLRKKLALDDDVFFSGLCYGDKLKEEAEKRKWPQMQSYHKMRTALDKVGKGTIGTLTEFQLNAIASILTQYKSDARRIAALREAGIPMQFDEALLPLSFSKYGNLSVKAMQRLIPLLEQGMRYDEACTQIYGDHRGLHSEQRKSKLSLNDMEEITNPVVRRAVSQTIKVVNAVVRTYGPPDVVRIELAREMSQNFDDRRKAEKRQEENRAANERVKEQIAEYKGDRATGLDIVKFKLYREQDGVCLYSGKNLDIGRLFEPGYADVDHIIPYSRCFDDSYQNKVLVLASENRQKGNRLPYEYFGQDETRWHEYEVRVENLIRNYRKRQKLLKKQLTEEESTGFIDRNLKDTQYITRSIYNLLRDNLAFAESRYSKKPVQTVNGAVTSMLRSRWGVQKIREDGDLHHCMDAAVIAATSPGLVQRLTEYSKRREALEEAPRGYVDPSTGELVEQSEQPRRDPFPKPWEQFHQELEARLATVDPRHQIDLLKLATYESDEEVKPVFVSRMPNHKVTGAAHAETIRSSKGGDGYTVTKTPLISLKLNKSGEIDGYYNWSSDKLLYDALLARLKEFGGDGAKAFAEPFYKPKRDGTPGPRVDKVKICERATTGLPVRDGIAANGSMVRIDVFYVEDEGYYFVPIYVADTKKECLPNKAVVAYKAYSDWKEMTDENFIFSLYPGDLVRIQSRKGIKLNIAKGGTGEKEIVRQDGMYYYQTANISSGAITISTHDRRYSQPSLGIKTLQSIEKYQVDVLGNYYKVDLPEKRMSFSEEG

SEQ ID NO: 1528 - protein, 1007 aa, unidentified
  REGION 1..1007: note = Description of Unknown:uncultivated organism with predicted taxonomy: Clostridialesbacterium 42_27
  REGION 1..1007: note = MG21-18 effector
AMFAAGGFKKSPYRLRAEALDRLLSKEETVRVLIHLAQRRGYKSNSMAEAAKDEKETGKVKSAVEENRACMEQHGYRTVGEMMFRDERFWQSNPDGTRYHQTRNEAEDYRFTVERSDIVNEAKQIFAAQRQFRADWMDDGMEAAYLSILESQRSFDEGPGGDSPFRGGIGEKVGFCTFEPEEHRAAKATYTFEYFKLLQDLNHMRLAGSGTAPQPLNAQQREILKAAALQSASLSYGQLRKKLALDDDVFFNGLYYGDKPREEAEKRKWPQMQSYHKIRTALNKAGKGTIRSLTEEQLNAITSILTQYKSDARRIEKLREAGIPELFDNALLPLSFSKYGNLSVKAMQRLIPLLEQGMRYDEACTQIYVDHRGLHPEQRKNRLSLNDMEEIINPVVRRAVSQTIKVVNAVVRTYGPPDVVRIELAREMSRNFDDRRKAEKRQEENRAANERAKEQIVEYKGDCATGLDIVKFKLYREQDGVCLYSGQNLDLSRLFEPGYVDVDHIIPYSRCFDDSYQNKTLVLASENRQKGNRLPYEYFGQDEARWHEYEVRVENLIRNYRKRQRLLKKRLTEDESAGFIDRNLKDTQYITRSIYNLLRDNLAFAESRYSKKPVQTVNGAVTSMLRSRWGVQKIREDGDLHHCMDAAVIAATSPGLVQRLTEYSKQREAFVKAPAGYVDPSTGGLVEQSEASRRDPFPKPWEQFHQELEARLDPIDPQHQIDLLKLATYESDEEVKPVFVSRMPNHKVTGAAHAETIRSSKGGDGYTVTKTPLANLKLNKLGEIDGYYNPGSDKLLYDALLARLKEFGGDGAKAFAEPFYKPKRDGTPGPRVDKVKICEKATTGLPVRDGIAANGSMVRIDVFYVEDEGYYFVPIYVADTKKESLPNKAVVAYKAYSDWKEMIDENFIFSLYPGDLVRIQSRKGIKLNIAKGGTGEKEVVRQDGMYYYRAAGITVGAIQIETHDRRYLQPSLGLKTLQSIEKYQVDVLGNYYKVDLPEKRMKFSKEG

SEQ ID NO: 1529 - protein, 1193 aa, unidentified
  REGION 1..1193: note = Description of Unknown:uncultivated organism
  REGION 1..1193: note = MG21-19 effector
MQQKMEKPEMPYVLGLCLSTTSVGWSVLETDETGIPFRIADLGVRTFQEAKTNYKRSKCRTSRRRLQRKSCIKSRVSELFERSGLITKEALEEIFVKSGFEKDIIVLRKDGLDRKLENDEWARVLYNFTQRRGYKVVSAAREISAKKIAEESKKQNSKSNLSNEDKVAQEEAKRHAGLLAAVNNNTKELKKDNYRTIGEMFCSSKDERFMVKDGSNREIGRTTRNKHGIYSFAVSRELIKDEISKLFDAQRKQGNKFADKSFQKEYENIVFSHNDKSQDLRGNCFFEKGEKCAFKGGYTFEYFKLLCELNNIRIISTESKVDEAVRKITESQRNTIIGLYKKSPKLTPKDLSKKLNLKSSEYLRSFNTKQMQSYHEIREALNKVTKNIANDLSNEQFDEIGEILSLYKNDDERREKLQELRINVGLGNNGLGDAEIKSLLELNFSGTGSLSLKAMKNLIPYLEKGLSYGEACEKVYGDHRTQCGGERMEYLSFKKLKEEGALDSINSPVVARATTQAFKVINAVICKYGSPQSVHIELSRDIKCGSRTRERIAQENEANRERREKLINEVENIKKQKHCEKVNATEQEILKLQLYKDQHGKCLYSGKELDKDKVISESGYAEIDHIIPYSQSFDNSEANKVLTLSEENRNKGNDVPVAYILRKHKNSEKEYDAFVKRVKSVTKEVSNTNKDRQKILEKRKQNLLISPNFKVDELEGLLVRETVGVQNIQKRIADILRNYLRFYGEMPMEQHIVVTKNSITEAICEQLGLQRYYTKVSALSSALNAILIAVTPANYEAKVTQYVQSREEHYTDDGYIDPENGKKLTIEEFDAKYMPESDLKCIYSYLKEEIEIWMSSASDKKSINAKRGKLEKLHKKLGLKGKYENEINNWKPIFVSQMPDRKISGQAHAETIRSARIDIDENGKERIIAVAKTPLTSLKLDKNGEIDGYYMPSSDRLLYEELKNRLIKTKTSGKTYGNAEQAFKEPVYKPKKDGSQGPRVYKVKTWKPTTSNVKVAGGIAKKGDIVRVDIFHITGGKDQGYYFVPIYVADTIKNTLPKHAVVTNFKSSKVEWKEMDDSNFIFSLYKGDLIHIELCADCRDKDSNNKIRKAKDMYVYYDGVDFYQSGKCTNQSIGELNGAINVSWHDGSCEDSIHIKEINVLEKYEVDVLGNYHKVRLPERRQAFNLKYSQKEQ

SEQ ID NO: 1530 - protein, 1100 aa, unidentified; identical to SEQ ID NO: 1527
  REGION 1..1100: note = Description of Unknown:uncultivated organism with predicted taxonomy: Clostridiales
  REGION 1..1100: note = MG21-20 effector

SEQ ID NO: 1531 - protein, 808 aa, unidentified
  REGION 1..808: note = Description of Unknown:uncultivated organism with predicted taxonomy: Clostridialesbacterium 42_27
  REGION 1..808: note = MG21-21 effector
VERTKRLLERYDIITKKEVEAMYANQAHVKHLYNVYELRVLGIEQKLTNKELARVLISLVKKRGYKSNSKAEESNGEAGKLLTATRDNELLMQSKGYRTVAEMYLKDDKFKAKDKNGEILVDKDGSPLLKIKNSTGDYKNTTLRKLLVEEIKLILNKQKELNSKITDDFINEYLKIFESQRNFDDGPGFPSPYGGNLIENMLGNCTFEKEEKRAPKATYTFEYFKFLQTLNHIKIETINKKDDGTINKEKRELTSEEKEKLKELVFSKVTVTYSDVRKTLQLESNQRFNMFTYRDLLNYTEETNKEIEREKKLKEFESYKKIKTTLNHIEKNYITKLTTDELDEIGYALTVYKNDDKRKEYLENHTTNLSKEAIEELLKLSFSKVGNLSLKAMKKIIPELEKGVTYDKAVDKVYEDFRGTVDTQKKRKLSIKDFEQEISNPVVRRGLSQAIKVLNAITLRYNEKFGKPDVVVVELARELGKNFADRKAIEKRQNDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNLNDTKYICKYMYNLIRNHLEFSDNPNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLEAEKVYTYEDYDDVEPIFVSRMPRRKVTGTAH

SEQ ID NO: 1532 - protein, 769 aa, unidentified
  REGION 1..769: note = Description of Unknown:uncultivated organism with predicted taxonomy: Clostridiales
  REGION 1..769: note = MG21-22 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMDEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMEEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQCLTAYNKHRETWERPPAG

SEQ ID NO: 1533 - protein, 861 aa, unidentified
  REGION 1..861: note = Description of Unknown:uncultivated organism with predicted taxonomy: Roseburiainulinivorans
  REGION 1..861: note = MG21-23 effector
VLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYNPQTDPRLYQALVERLRQFDGEGKKAFAEPFYKPKKDGTPGPRVDKVKIAEKASLSVSTGRGVADNGEMIRMDVFRVPNERKPDDSYYFVPIYVAD

SEQ ID NO: 1534 - protein, 1107 aa, unidentified
  REGION 1..1107: note = Description of Unknown:uncultivated organism with predicted taxonomy: Firmicutes
  REGION 1..1107: note = MG21-24 effector
MKKRKKKKKDKKDCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDMVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILSEVSIFFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGQDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAEENRQKGNRTPYEYFGADEQRWHEFSARVRASVRDFKKRQKLLNTSFGEEQKNEFTQRNLNDTQHITRVVYNYLRNNLEFADSAYAKAPVQAVNGAVTAMLRGRWGIEKMRGDGDLHHCKDAVVIAATSRSMIEDLTKYYQEEEQRFMGKTHFVDPATGEVLTRKEFPQPWPRFREELEARLDPIDPMEAVMALHLSTYEPEEEIAPVFVSHMPKHTVTGAAHEETIRSRTETGTVVKTALTSLKLDKNGGIEGYYNPQTDPRLYQALVERLRQFDGKGEKAFAEPFYKPKKDGTPGPRVDKVKIERKSSLSVSTGRGVADNGRMVRIDVFRVPDDGYYFVPIYVADTKKAVLPSKAVVAGKSPEAWKQMKPERFLFSLFKDDLIYVESRKGISLALAKEAVGEKTIQPKSGLFYFCGANISSGSIGIETDDRRYGKESLGLKTLTLIEKCQVDVLGNVSKVRLPEKRLEFRGRK

SEQ ID NO: 1535 - protein, 1058 aa, unidentified
  REGION 1..1058: note = Description of Unknown:uncultivated organism with predicted taxonomy: Clostridialesbacterium 42_27
  REGION 1..1058: note = MG21-25 effector
KAEQPKTGASLAAPRRDARSARRRLRRHRHRLERIHYLMEQRGIMPVADIQAMYAAGGFQKSPYQLRAEALDRPLIKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGVVWMDEDMETAYLSVLESQRRFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARHDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1536 - protein, 1100 aa, unidentified
  REGION 1..1100: note = Description of Unknown:uncultivated organism with predicted taxonomy: Ruminococcaceaebacterium TF06-43
  REGION 1..1100: note = MG21-26 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTVIEENRRCMAEYGYRTVGEMMYRDERFWQKHPDGTRYHQTRNKAEDYRFTVERAAIVDEVRQIFAAQRKLGVVWMDEDMETTYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGTKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1537 - protein, 1098 aa, unidentified
  REGION 1..1098: note = Description of Unknown:uncultivated organism with predicted taxonomy: Clostridiales
  REGION 1..1098: note = MG21-27 effector
LSLRYTLGLDIGIASVGWAVLENNIDGEPIKIERLGVRIFDKAEHPKTGASLAEPRREARGQRRTIRRKRHRKDRIKQLIQQNGIMTRVEMSEMFEHSQFETSVYELRVQALERALTKQEFVRVLIHLAQRRGYKSNSKSEEAKDKENGKVKSAISENKQCMEENGYRTIGEMLLHDDRFWECNPDGTKIFVPHNHLDDYRTTVERSMVEDEIRLIFSQQRALGVSYVTAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSATASYAQLRKKLELSNDISFNMLRYGSDEIEKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIEPINNPVVRRAVSQTIRVINAVVREYGAPEVVRVELAREMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKQTHKISGAAHEATIRSAKKPGGSISKKTLTSLSLNKKTGEIEGYYAPESDRLLYEALKKRLEEFDGNAKEAFAEPFYKPKRDGTRGPLVKKVKIYEKKTITVPVNGGNADNGSMIRVDVFYMEDDGYYYVPIYTADVIKGKLPNKAVVQGKTFEDWKEMDDRDFLFSMYPSDLLYIESRRGIKLKTKKGSSWQEEIARKAGLYYFKGLNISSGNLFIITHDHSYEQSSLGGKTLSCLKKYTVDALGNYSEVSLPEKRKPLRG

SEQ ID NO: 1538 - protein, 1100 aa, unidentified
  REGION 1..1100: note = Description of Unknown:uncultivated organism with predicted taxonomy: Clostridialesbacterium 42_27
  REGION 1..1100: note = MG21-28 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1539 - protein, 1100 aa, unidentified
  REGION 1..1100: note = Description of Unknown:uncultivated organism with predicted taxonomy: Firmicutes
  REGION 1..1100: note = MG21-29 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGQSPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEIANPVVRRAVSQTIKVINAVVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGNDDVRWHEYEVRVENLIRNYRKRQKLLKRQLSEEESAGFIDRNLKDTQYITRAIYTLIRDNLVFAESNYKKRPVQTVNGAVTSMLRNRWGVQKIREDGDLHHCLDAAVIAATTPGLVQRLTEHSKRRETLEKAPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1540 - protein, 836 aa, unidentified
  REGION 1..836: note = Description of Unknown:uncultivated organism with predicted taxonomy: Clostridialesbacterium 42_27
  REGION 1..836: note = MG21-30 effector
RVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAAVAMKPYNLWKKMKDENFVFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1541 - protein, 1103 aa, unidentified
  REGION 1..1103: note = Description of Unknown:uncultivated organism
  REGION 1..1103: note = MG21-31 effector
MKKGQKHCHYTLGLDIGIASIGWAVLGNDEDGTPNRIIDLGVRIFDKAEVENTGESLAAPRRDARSARRRLRRHRHRLERIRYLLVQQGVLTQEEMTHLYDKSDMVSPYQLRTEGLDRLLNAREFSKVLIHLAQRRGYQSNSTAEEVKNEKENGIIKSAILENQQRMEQGGYRTIGEMMYRDAAFWETINGIRYHCTRNKAGDYRFTVDRASILAEVSIFFEAQRRLGSPWASVEMEDAYTGILSSQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVRIYGKPDAVRIELAREMHHSIKERNRMKKRQEENREKNEQVKAQILETKPGTRVTGLDIVKFKLYQEQDGICLYSGKPLEIERLYEPGYAEVDHIIPYSRCFDDSYSNKVLVLAEENQQKGNCTPYEYFGADEQRWHEFSVRVGASVRDFKKRQKLLNTSFGEEQGKDFIQRNLNDTQHITRVVYNYLRNNLEFADSAYAKAPVQAVNGAVTAMLRGRWGIEKMRGNGDLHHCKDAVVIAATSDSMIKDLTKYYQEEEQRFMGKTHFVDPATGEVLTRKEFPQPWPRFREELEARLDPTNPKEALMALNLSTYEFDPEEEIPPVFVSHMPKHTVTGAAHEETIRGKTETGTVVKTALTSLKLDKNGEIEGYYNPQTDPRLYQALVERLRQFDGKGEKAFAEPFYKPKKDGTPGPRVDKVKIERKSSLSVSTGRGVAKNGDMIRMDVFRIPNERKPDDSYYFVPIYVADTKKRILPSRAVVRGKLPEEWKQMKPEHFLFSLFKGDLIYVESKKEISLALAKEAVGEKTIQVKSGLFYFCGANISNGSIEIETHDRRYGKEGLGIKKLKVFEKRQVEVLGEVRKVKLPEKRLEFRGRK

SEQ ID NO: 1542 - protein, 1100 aa, unidentified
  REGION 1..1100: note = Description of Unknown:uncultivated organism with predicted taxonomy: Ruminococcaceaebacterium TF06-43
  REGION 1..1100: note = MG21-32 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVQVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPASYVDPATGDLLELPQEARRDLFPKPWERFRQELEARLNPIDPRHQIDLLKLSTYESDEEIKPVFVSRMPNHKVTGAAHAETIRSRKGGDGFTVTKTPLTNLKLNKFGEIEGYYNPASDTLLYNALLSRLKDFGGDGAKAFAKPFYKPKKDGTPGPRVDKVKICEKATIGLPVRNGIAANGSMIRIDVFYVEDDGYYFVPIYVADTKKERLPNKAVVAYKAYSEWKEMKDENFIFSLYPGDLVRIQSRKGIKLTLTKGGTGEPEIVRQQGMYYYQTANISSGAVTISTHDRRYSQSSLGIKTLQSIEKYQVDVLGNYYKVDLPEKRMTFSKEG

SEQ ID NO: 1543 - protein, 1097 aa, unidentified
  REGION 1..1097: note = Description of Unknown:uncultivated organism with predicted taxonomy: Clostridiales
  REGION 1..1097: note = MG21-33 effector
LSLRYTLGLDIGIASVGWAVLENNIDGEPIKIERLGVRIFDKAEQPKTGASLAEPRREARGQRRTIRRRRHRKDRIKQLIQQNDIMTRVEMAEMFEHSQFETSVYELRVQALERALTKQEFVRVLIHLAQRRGYKSNSKSEEAKDKENGKVKSAISENKKCMEENGYRTIGEMLLNDDRFWEYNPDGTKIFVPHNHPDDYRTTVERSMVEDEIRLIFSRQHALGVPYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLGLSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPSMIQKITQYTKHRECIRKTKEGYLDTETGELMTREAYDAKYSPRFPAPWERFRQELEARLSDNPAEEIARLHLATYDSEEEIKPVFVSRKQTHKISGAAHEATLHRKADGGYINKVSLTKLTLDKKTGEIKNYYAPESDRLLYEALKKRLKEFDGNAKEAFAEPFYKPKRDGTRGPLVKKVKLYEKKTITVPVGGGNADNGSMIRVDVFYIEDDGYYYVPIYTADVIKGALPNRAVVADKSHGEWKVMNDKDFLFSMYPNDLLYIESRKGIKLKTKKGSSKQEQIVRKTGLYYFKGLNISSNALSIITHDHSYEQSSLGGKTLSCLKKYTVDALGNYSEVSLPEKRKPLRG

SEQ ID NO: 1544 - protein, 1100 aa, unidentified
  REGION 1..1100: note = Description of Unknown:uncultivated organism with predicted taxonomy: Clostridiales
  REGION 1..1100: note = MG21-34 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1545 - protein, 1100 aa, unidentified
  REGION 1..1100: note = Description of Unknown:uncultivated organism with predicted taxonomy: Clostridiales
  REGION 1..1100: note = MG21-35 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMDEITNPVVRRAVSQTIKVINAVVRTYGPPDVVRIELAREMSRTFDERRKMEKRQDDNRAANERAKNQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGSPGPRVDKVKICEKATVGLPVRDGIAANGSMVRIDVFYVEDDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1546 - protein, 1127 aa, unidentified
  REGION 1..1127: note = Description of Unknown:uncultivated organism
  REGION 1..1127: note = MG21-36 effector
MNYRIGLDLGIASVGWAVLEDDYMGKPKRIVKLGARIFDSAENPKDGSSLALNRREARETRRRLRRRNHRIKRTKNLLEKYNIMTTKEIEDMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKTKVTLTYASLRIALNLAGNERFNMIHYKATNVFSDEINKEAEKERKFKEFESYHKMRVSMDKAEKNYILKLSTDELDVIGTVLTLYKNDNKRIEKLAQLNLPENIINEMLKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNKIPYQYMQEKGRDLDEYEIRVNNIIKNYSKKQRLLKQKFTREDANEWKDRNIQDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKPYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1547 - protein, 1100 aa, unidentified
  REGION 1..1100: note = Description of Unknown:uncultivated organism with predicted taxonomy: Clostridiales
  REGION 1..1100: note = MG21-37 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1548 - protein, 1100 aa, unidentified
  REGION 1..1100: note = Description of Unknown:uncultivated organism with predicted taxonomy: Clostridialesbacterium 42_27
  REGION 1..1100: note = MG21-38 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFFGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1549 - protein, 1100 aa, unidentified
  REGION 1..1100: note = Description of Unknown:uncultivated organism with predicted taxonomy: Clostridiales
  REGION 1..1100: note = MG21-39 effector
MSEFHYALGLDIGIGSVGWAVLRNQTNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLSEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLNPIDPRHQIDLLKLSTYESDEEIKPVFVSRMPNHKVTGAAHAETIRSRKGGDGFTVTKTPLTNLKLNKFGEIEGYYNPASDTLLYNALLSRLKDFGGDGAKAFAKPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1550 - protein, 1100 aa, unidentified
  REGION 1..1100: note = Description of Unknown:uncultivated organism with predicted taxonomy: Clostridiales
  REGION 1..1100: note = MG21-40 effector
MSDFHYALGLDIGIGSVGWAVLRNRPDGEPDRIQDLGVRIFDKAEQPKTGASLAAPRREARSARRRLRRHRHRLERIRYLMEQHGIMPISDIQAMYAAGGFEKSPYQLRAEALDRPLSREELVRVLIHLAQRRGYRSNSTAEAAKNEKETGKVKSAIEENRACMEQHGYRTVGEMMFRDERFWQNNPDGTRCHQTRNKAEDYRFTVERTAIVDEAKQIFTAQRRFGADWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFHHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEKRRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDEARWHGYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPQHQIDLLKLATYESDEEIRPVFVSRMPNHKVTGAAHAETIRSSKGGDGFTVTKTPLANLKLNKFGEIEGYYNPASDTLLYNALLARLKDFGGDGAKAFAQPFYKPKKDGTPGPRVDKVKICEKATIGLPVRNGIAANGSMIRIDVFYVEDDGYYFVPIYVADTKKAELPNKAVVAYKAYSDWKEMIDENFLFSLYPGDLVRIQSRKGIKLNIAKGGTGEKEIVRQDGLYYYQGANIATGAIALATHDRRYLQSGLGLKTLQSIEKYQVDVLGNYYKVDLPEKRMKFSKEG

SEQ ID NO: 1551 - protein, 1102 aa, unidentified
  REGION 1..1102: note = Description of Unknown:uncultivated organism with predicted taxonomy: Firmicutes
  REGION 1..1102: note = MG21-41 effector
MKKGQKHCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDTVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILAEVSILFEAQRRLGAPWASVEMEDAYTAILSGQRSFDEGPGGDSPFRKGISDRVGYCTLEPTEQRAAKADATFEYFKLLQDLNHMRLVDNSGSHPLTQQQRALLEEMAFRSANLTYGQLRKKLGLLDEVRFAGLYYGEDTIEKAEKRKWAQMQSYHKIRTALDKVSKDAISMFDKDQLDAIGEILTAYKADAARIEHLQTAGIQKEYHKALLSLSFSKYGKLSCCAMRKLIPFLQQGMRYDEACREVYQDHRTKEASEKKQRLSLNDIDEITNPVVRRAVSQTIKVVNAVVRTYGNPDAVRIELAREMSHSFDERNKMKKRQEDGWQKNEQVKAQILETKTGTRVTGLDIVKFKLYQEQDGICLYSGTPMEIERLYEPGYADVDHIIPYSRCFDDSYSNKVLVLASENRQKGNRTPYEYFGANEQRWHEFSVRVGASVRDFKKRQKLLNTSFGEEQGKEFIQRNLNDTQHITRVVYNYLRNNLEFADSAYAKAPVQAVNGAVTAMLRGRWGIEKMRGDGDLHHCKDAVVIAATSRSMVQRLTNYYKEEERLFMGKTHFVDPATGEVLTRKEFQQRFAPKFPQPWDRFREELEARLDPIDPMEAVMALHLSTYEPEEEIAPVFVSHMPKHTVTGAAHEETIRSRTETGTVVKTALTSLKLDKNGEIEGYYNPQTDPRLYQALVERLKKFGGDGAKAFAEPFYKPKKDGTPGPRVDKVKIERKSSLSVSTGRGVADNGRMVRIDVFRIPDDGYYFVPIYVADTKKATLPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 1552 - protein, 818 aa, unidentified
  REGION 1..818: note = Description of Unknown:uncultivated organism with predicted taxonomy: Clostridiales
  REGION 1..818: note = MG21-42 effector
EKRELTSEEKEKLKELVFSKVTVTYSDVRKTLQLESNQRFNMFTYRDLLNYTEETNKEIEKEKKLKEFESYKKIKTALNHIEKNYITKLTTDDLDEIGYALTVYKSNDKRKEYLEKHTPNLSKEAIEELLKLSFSKVGNLSLKAMKKIIPELEKEVTYDKAVDKVYEDFRGTVDTQKKRKLSLKDFEQEISNPVVRRGLSQAIKVLNAITLRYNEKFGKPDVVVVELARELGKNFADRRTIEKRQSDNTQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNSKKKQNLLRQDFTREDAEDWKERNLNDTKYICKYMYNLIRNHLEFSDNANFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLESEKIYTYEDYDDVEPIFVSRMPRRKVTGPAHVATIRGIKEKDGELKTITKTELTKLKLKDGEIEGYPENCRRDDRLLYEALKNRLIEFNGDAVKAFSEPFYKPKSDGTRGPIVNKVKIEANTTMGVTLNDKKAFAANGDCVRLDIFYVENEGYYFIPIYVSDTVKKELPNKACVSGKKYADWKEMKDENFIFSIYPKDLIYIQGKNKIKLNPVIKDKDSIEVEDIFAYYIKAGISSAVITIQTNEGKYVQPSLGIKSLKKLEKYEVDILGNYHKVKLPEKRLPFNINKK

SEQ ID NO: 1553 - protein, 843 aa, unidentified
  REGION 1..843: note = Description of Unknown:uncultivated organism with predicted taxonomy: Clostridialesbacterium 42_27
  REGION 1..843: note = MG21-43 effector
FSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANKRAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHPCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRGSDISTGAISVSSHDRRYESRGIGVKTLQSIEKYQVDVLGNYYKVDLPEKRMTFSKEG

SEQ ID NO: 1554 - protein, 1128 aa, unidentified
  REGION 1..1128: note = Description of Unknown:uncultivated organism with predicted taxonomy: Clostridiales
  REGION 1..1128: note = MG21-44 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLLKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIAANGDMIRIDVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 1555 - protein, 1100 aa, unidentified
  REGION 1..1100: note = Description of Unknown:uncultivated organism with predicted taxonomy: Clostridiales
  REGION 1..1100: note = MG21-45 effector
MSEFHYALGLDIGIGSVGWAVLRNQPYGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGKRVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1556 - protein, 818 aa, unidentified; identical to SEQ ID NO: 1552
  REGION 1..818: note = Description of Unknown:uncultivated organism with predicted taxonomy: Clostridiales
  REGION 1..818: note = MG21-46 effector

SEQ ID NO: 1557 - protein, 1098 aa, unidentified; identical to SEQ ID NO: 1537
  REGION 1..1098: note = Description of Unknown:uncultivated organism with predicted taxonomy: Clostridiales
  REGION 1..1098: note = MG21-47 effector

SEQ ID NO: 1558 - protein, 848 aa, unidentified
  REGION 1..848: note = Description of Unknown:uncultivated organism with predicted taxonomy: Clostridialesbacterium 42_27
  REGION 1..848: note = MG21-48 effector
LMEQRGIMPVADIQAMYAAGGFQKSPYQLRAEALDRPLIKEEAVRVLIHLAQRRGYKSNSTAEAAKDEKETGKVKTAIEENRRCMAEHGYRTVGEMMFRDERVWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDK

SEQ ID NO: 1559 - protein, 1100 aa, unidentified
  REGION 1..1100: note = Description of Unknown:uncultivated organism with predicted taxonomy: Clostridialesbacterium 42_27
  REGION 1..1100: note = MG21-49 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1560 - protein, 1100 aa, unidentified; identical to SEQ ID NO: 1538
  REGION 1..1100: note = Description of Unknown:uncultivated organism with predicted taxonomy: Clostridialesbacterium 42_27
  REGION 1..1100: note = MG21-50 effector

SEQ ID NO: 1561 - protein, 983 aa, unidentified
  REGION 1..983: note = Description of Unknown:uncultivated organism with predicted taxonomy: Clostridialesbacterium 42_27
  REGION 1..983: note = MG21-51 effector
MSEFHYALGLDIGIGSVGWAVLRNQPNGEPDRIQDLGVRIFDKAEQPKTGASLAAPRRDARSARRRLRRHRHRLERIRYLMEQRGIMSVSDIQAMYAAGGFQKSPYQLRAEALDRPLSKEEAVRVLIHLAQRRGYKSNSTAEAAKDEKETGKVKTAIEENHRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFSGGIGERVGACTFEPDEKRAAKATYTFEYFKLLQDLSRMRLTGMGMPPEPLDDEQREVLKSAALRSASLSYGQIRKKLNLDDDVFFHGLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDVACTRVYGDHRGLRPGQRTNRLSLKDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIREHLVFAESAYRKKPVQTVNGAVTSMLRGRWGVQKIREDGDLHHCLDAAVIAATTPGLVQRLTAYNKRRESWERSPAGYVDPATGELIVLPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAA

SEQ ID NO: 1562 - protein, 1026 aa, unidentified
  REGION 1..1026: note = Description of Unknown:uncultivated organism with predicted taxonomy: Clostridialesbacterium 42_27
  REGION 1..1026: note = MG21-52 effector
ERIRYLMEQRGIMPVADIQAMYAAGGFQKSPYQLRAEALDRPLTKEEAVRVLIHLAQRRGYKSNSTAETAKDEKETGKVKTAIEENRRCMAEHSYRTVGEMMYRDERFWQKHPDGTRYHQTRNKAEDYRFTVERAAIVDEARQIFAAQRRLGTVWMDEDMETAYLSILESQRSFDEGPGGDSPFSGGIGERVGACTFEPDEKRAAKATYTFEYFKLLQDLNRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIQPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGNMVRIDVFYVEDDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1563 - protein, 1097 aa, unidentified
  REGION 1..1097: note = Description of Unknown:uncultivated organism with predicted taxonomy: Clostridiales
  REGION 1..1097: note = MG21-53 effector
LSLRYTLGLDIGIASVGWAVLENNIDGEPIKIERLGVRIFDKAEETDGSPLAKHRREARGQRRTIRRKRHRKDRIKQLIQQNGIMTRVEMSEMFEHSQFETSVYELRVQALERTLTKQEFVRVLIHLAQRRGYKSNSKSEEAKDKENGKVKSAISENKQCMEENGYRTIGEMLLNDDRFWECNPDGTKIFVPHNHLDDYRTTVERSMVEDEIRLIFSQQRALGVSYATAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSAKSLRKLIPYLEKGMTYAEACKEVYGEHKSSITKKNKLSLFDIELINNPVVRRAVSQTIRVINAVVREYGAPEVVRVELAREMGKPYDVRTQITKKQEANAKKNEELRQQIKKIKGAEPTGQDIVKFKLFQEQKGVCLYSGQNLDITRLFEAGYVDVDHIVPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKPERKTTGAAHEATIRSAKKPGGSISKKPLTSLSLNKKTGEIEKYYAPESDRLLYEALKKRLEEFDGNAKEAFAKPFYKPKRDGTRGPLVKKVKLYEKKTITVPVNGGNADNGRMIRVDVFYMEDDGYYYVPIYITDVVKDELPNKAVVQKKLPEDWKEMDDRDFLFSMYPNDLIYVERKEVFELTAPKGSSLDPTISKTKGFFYYRSFDSNTGSFKIYTHDSSYSKKSLGGKTLSCLKKYTVDVLGNYSEVSLPEKRKPLRG

SEQ ID NO: 1564 - protein, 1100 aa, unidentified
  REGION 1..1100: note = Description of Unknown:uncultivated organism with predicted taxonomy: Clostridiales
  REGION 1..1100: note = MG21-54 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDHPLSKEEAVRVLIHLAQRRGYKSNSTAEAAKDEKETGKVKTAIEENRRCMAEHGYRTVGEMMFRDERFWQKHPDGTRYHQTRNKAEDYRFTVERAAIVDEVRQIFAAQRRLGVVWMDEDMEIAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNNLYYGEKTKEEAEKRKWPQMQSYHKLRTALDKVGKGAIGTLTEEQLNAVATILTEYKSDAKRIAALREAGIPPQFDEALLPLSFSKYGSLSVRAMQKLIPLLEEGLRYDGACTRVYGDHRGLRPGQRTNRLSLKDMEEITNPVVRRAVSQTIKVINAVVRTYGPPDVVRIELAREMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRTVYNLIRDHLAFAESAYRKKPVQAVNGAVTAMLRGRWGVQKIREDGDLHHCLDAAVIAATTPGLVQRLTAYNKHRETWERPPAGYVDPVTGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKIREKATVGLPVRNGIAANGSMVRIDIFYVEDDGYYFVPIYVADTKKDRLPSKAPVAHKAYSAWKEMRNENFIFSLYPGDLVRIQSRAGIKLSLAKDGTGEKEIVRQNGLYYYRSADIEGGKIDIEAHDRRYSKHGLGLKTLQSIEKYQVDVLGNYYKVDLPEKRMTFSKEG

SEQ ID NO: 1565 - protein, 986 aa, unidentified
  REGION 1..986: note = Description of Unknown:uncultivated organism with predicted taxonomy: Ruminococcaceaebacterium TF06-43
  REGION 1..986: note = MG21-55 effector
LLNAREFSKVLIHLAQRRGYQSNSTAEEAKNEKENGIIKSAILENQQRMEQGGYRTIGEMMYRDAAFWETINGIRYHCTRNKAGDYRFTVDRASILSEVSLLFEAQRRLGSPWASVEMEDAYTAILASQRSFDEGPGNDSHGNESPFRKAMSHNVGNCTLIPTEPRAARADYTAEYFKLLQDLNHMRLVDNSGSHPLTQQQRAILEEMAFRSANLTYGQLRKKLGISDEVRFAGLYYGQDTIEKAEKRKWPQMQSYHKIRTALDKVSKDAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVREYGNPDAVRIELAREMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAKENQQKGNCTPYEYFGADEQRWHEFSARVRASVRDFKKRQKLLNTSFGEEQGKEFIQRNLNDTQHITRVVYNFLRNNLEFADSAYAKAPVQAVNGAVTAMLRGRWGIEKMRGNGDLHHCKDAVVIAATSDSMIEDLTDYYKEEERLFMGKTHFVDPATGEALTRKEFQQRFAPQFPQPWPRFREELEARLDPIDPMEAVMALHLSTYEPDEEIAPVFVSHMPKHTVTGAAHEETIRGKTETGTVVKTALTSLKLDKNGEIDGYYNPQTDPRLYQALVERLKKFGGDGARAFAEPFYKPKKDGTPGPRVDKVKIKSKSSLSVPTGRGVAKNGDMIRMDVFHVPDDGYYFVPIYVADTKKAILPSKAVVAGKSPEAWKQMKPEHFLFSVFKGDLIYVESKTEISLALAKNAVGEKTIQVKSDLFYFCGADISNGSIKIKTHDRRYEQKKLGIKKLEVLEKYQVDVLGNVSKVKLPETRLEFRGRK

SEQ ID NO: 1566 - protein, 1046 aa, unidentified
  REGION 1..1046: note = Description of Unknown:uncultivated organism with predicted taxonomy: Clostridialesbacterium 42_27
  REGION 1..1046: note = MG21-56 effector
PPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDPLTAETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1567 - protein, 1098 aa, unidentified
  REGION 1..1098: note = Description of Unknown:uncultivated organism
  REGION 1..1098: note = MG21-57 effector
MTSQAIRYTLGLDIGIASVGWAVLKNGSDGEPYKIENLGVRIFDKAEVPKTGASLAAPRREARSSRRVVRRRRHRKERIKYLIEQEGIMTQTEMMQLFQNSSFEKSVYEIRVEALDRLLTREEAVRLLIHFAQRRGYKSNSKAEEAKDNENGVIKQAISQNKQVMKAHGYRTFGEMLLMDDRFYYTQPDGARIFIPHNKASDYKVTAERGMLADELHMIFAAQRSLGSLWFSDTFETAYMEVWSSQRSFDEGPGGNSQYGGNQIEKMLGKCFDGELRAPKASYSAEYFRLLQDINHLRIVSLDGASSPLTQEQRDIVVAASKKSGTLTYTQLRKKLALADDQYFNALYYGDKTTAEIEKKKFGHLQFYHQLRTVLDKVEKGAADTLTWEQRDEIARILTVYKADDRRTDELQKAGIPEKYIDALLPLSPTKAMHLSITAIKKIIPYLEAGMPYSDALSKAYGNQTNASTSSKKHKLSLSDIEEITNPVVRRAVSQSIKVINAIVRQYGAPERVRIELAREMGKNFKDRRMIETRQTDNAAKNERIKAQISEYKSDHITGQDIVKFKLFKEQDGICLYSGKSLNIARLFEPGYVDIDHIIPYSISFDDSYNNKVLVLSSENRQKGNRIPYAYFGQNSDRWEKYETLVNNTVRSYRKRKNLLLKSLSEAQIDGFKQRNLQDTQYLSKVVFRLIEDHLQFAETAPGKKHTQPVNGAITAQVRKRLGIEKIREDGDLHHAMDAAVIACITPGMIQRITKYAQNHERFYATAKGYADIKTGEVLTRAQYEAMDDIRFPEPWAGFRLELEARVSDHPQEAIAQLKLPHYENSEEIRPIFVSRMPNHKVTGAAHLETIRSKKGGAGSTVTKTALTELKLGKDGEIAGYCRKEDDPLLYEALKARLKAFGGDGKKAFAEPFHKPKHNGEPGPIVNKVKIQESATLTVPVNHGVAANGSMVRLDVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRFNRRGLGGKTLLSIEKYQVDVLGNYFPVALPEKRMKFR

SEQ ID NO: 1568 - protein, 1100 aa, unidentified
  REGION 1..1100: note = Description of Unknown:uncultivated organism with predicted taxonomy: Oscillibactersp. CAG:241_62_21
  REGION 1..1100: note = MG21-58 effector
MLEFHYALGLDIGIGSVGWAVLRNQENGEPDRIQDLGVRIFDKAEQSKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPEKRMTFSEEG

SEQ ID NO: 1569 - protein, 1100 aa, unidentified
  REGION 1..1100: note = Description of Unknown:uncultivated organism with predicted taxonomy: Clostridiales
  REGION 1..1100: note = MG21-59 effector
MLEFHYALGLDIGIGSVVWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADDYRFTVERAAIVDEAKRIFAAQSSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1570 - protein, 1100 aa, unidentified; identical to SEQ ID NO: 1538
  REGION 1..1100: note = Description of Unknown:uncultivated organism with predicted taxonomy: Firmicutes
  REGION 1..1100: note = MG21-60 effector

SEQ ID NO: 1571 - protein, 1100 aa, unidentified; identical to SEQ ID NO: 1544
  REGION 1..1100: note = Description of Unknown:uncultivated organism with predicted taxonomy: Clostridiales
  REGION 1..1100: note = MG21-61 effector

SEQ ID NO: 1572 - protein, 1100 aa, unidentified
  REGION 1..1100: note = Description of Unknown:uncultivated organism with predicted taxonomy: Firmicutesbacterium CAG:129
  REGION 1..1100: note = MG21-62 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALMEAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1573 - protein, 1100 aa, unidentified
  REGION 1..1100: note = Description of Unknown:uncultivated organism with predicted taxonomy: Clostridiales
  REGION 1..1100: note = MG21-63 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLELETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1574 - protein, 1100 aa, unidentified
  REGION 1..1100: note = Description of Unknown:uncultivated organism with predicted taxonomy: Clostridiales
  REGION 1..1100: note = MG21-64 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1575 - protein, 833 aa, unidentified
  REGION 1..833: note = Description of Unknown:uncultivated organism with predicted taxonomy: Clostridialesbacterium 42_27
  REGION 1..833: note = MG21-65 effector
LSLRYTLGLDIGIASVGWAVLENNIDGEPIKIERLGVRIFDKAEETDGSPLAKHRREARGQRRTIRRKRHRKDRIKQLIQQNGIMTRVEMSEMFEHSQFETSVYELRVQALERALTKQEFVRVLIHLAQRRGYKSNSKSEEAKDKENGKVKSAISENKQCMEENGYRTIGEMLLNDDRFWECNPDGTKIFVPHNHLDDYRTTVERSMVEDEIRLIFSQQRALGVSYVTAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSATASYAQLRKKLELSNDISFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIELINNPVVRRAVSQTIRVINAVVREYGAPEVVRVELAREMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVS

SEQ ID NO: 1576 - protein, 1100 aa, unidentified; identical to SEQ ID NO: 1574
  REGION 1..1100: note = Description of Unknown:uncultivated organism with predicted taxonomy: Clostridiales
  REGION 1..1100: note = MG21-66 effector

SEQ ID NO: 1577 - protein, 1100 aa, unidentified; identical to SEQ ID NO: 1539
  REGION 1..1100: note = Description of Unknown:uncultivated organism with predicted taxonomy: Clostridia
  REGION 1..1100: note = MG21-67 effector

SEQ ID NO: 1578 - protein, 1100 aa, unidentified
  REGION 1..1100: note = Description of Unknown:uncultivated organism with predicted taxonomy: Clostridiales
  REGION 1..1100: note = MG21-68 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1579 - protein, 1109 aa, unidentified
  REGION 1..1109: note = Description of Unknown:uncultivated organism with predicted taxonomy: Firmicutes
  REGION 1..1109: note = MG21-69 effector
MKKGQKHCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDMVSPYQLRTEGLDRLLNAQEFSKVLIHLAQRRGYQSNSTAEEAKNEKENGIIKTAILENQQRMERGGYRTIGEMMYRDAAFWETINGIRYHCTRNKAGDYRFTVDRASILAEVSILFEAQRRLGSPWASVEMEDAYTAILSGQRSFDEGPGNDSHGNESPFRKAMSHNVGNCTLIPTELRAARADYTAEYFKLLQDLNHMRLMDNSGSHPLTQQQRAILEEMAFRSANLTYGQLRKKLGLSDEVRFAGLYYGEDTIEKAEKRKWAQMQSYHKIRTALDKVSKNAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDNYSNRKEMKLDAVRIELAREMHHSIKERNRMKKRQEENREKNEQVKAQILETKPGTRVTGLDIVKFKLHQEQKGFCPYSGVEIKKERLYEPGYAEVDHIIPYSRCFDDSYSNKVLVLAEENRQKGNRTPYEYFGADEQRWHEFSARVRASVQDFKKRQKLLNTSFGEEQKNEFTQRNLNDTQHITRVVYNYLRNNLEFADSAYAKAPVRAVNGAVTAMLRGRWGIEKMRGNGDLHHCKDAVVIAATSRSMVQRLTNYYKEEERLFMGKTNFVDPATGEVLTRKEFQQRFAPKFPQPWDRFREELEARLDPIDPMEAVTALYLSTYEPEEEIAPVFVSHMPKHTVTGAAHEETIRSRTETGTVVKTALTSLKLDKNGEIDGYYNPQTDPRLYQALVERLRQFDGEGKKAFAEPFYKPKKDGTPGPRVDKVKIERKSSLSVSTGRGVADNGRMVRIDVFRVPDDGYYFVPIYVADTKKGILPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 1580 - protein, 1117 aa, unidentified
  REGION 1..1117: note = Description of Unknown:uncultivated organism with predicted taxonomy: Firmicutes
  REGION 1..1117: note = MG21-70 effector
MKKRKKKKKDKKDCHYTLGLDIGIASIGWAVLGNDEDGKPNRIIDLGVRIFDKAEVENTGESLAAPRRDARSARRRLRRHRHRLERIRYLLVQQGVLTQEEMTHLYDKNDMVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSSQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGQDTIEKAEKRKWAQMQSYHKIRTALDKVSKDAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVRIYGKPDAVRIELAREMSHSFDERNKMKKRQEDGWRKNEQVKAQILETKTGNRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVRAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYSPQTDPRIYQALVERLRQFNGKGEKAFAEPFYKPKKDGTPGPRVDKVKIERKSSLSVSTGRGVADNGRMVRMDVFRVPNERKPDDSYYFVPIYVADTKKGILPSKAVVAHKSPENWKQMKPEHFLFSLFKGDLIYVENSKGISLALAKEAVGEKTIQVKSGLFYFCGADISDGSIKIETHDRCYYKKSLGLKELDTVEKRQVEVLGEVRKVKLPEKRLEFRGRK

SEQ ID NO: 1581 - protein, 1107 aa, unidentified; identical to SEQ ID NO: 1534
  REGION 1..1107: note = Description of Unknown:uncultivated organism with predicted taxonomy: Clostridiales
  REGION 1..1107: note = MG21-71 effector

SEQ ID NO: 1582 - protein, 977 aa, unidentified
  REGION 1..977: note = Description of Unknown:uncultivated organism
  REGION 1..977: note = MG21-72 effector
VLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYNPQTDPRLYQALVERLRQFDGEGKKAFAEPFYKPKKDGTPGPRVDKVKIAEKASLSVSTGRGVADNGEMIRMDVFRVPNERKPDDSYYFVPIYVADTKKGILPWKQMKPEHFLFSIFKGDLIYVESKKEISLALAKEAVGEKTIQVKSGLFYFCGANISNGSIEIETHDRRYGKEGLGIKKLKVFEKRQVEVLGEVKKVKLPEKRLEFRGRK

SEQ ID NO: 1583 - protein, 1100 aa, unidentified
  REGION 1..1100: note = Description of Unknown:uncultivated organism with predicted taxonomy: Clostridiales
  REGION 1..1100: note = MG21-73 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIASLRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1584 - protein, 1097 aa, unidentified
  REGION 1..1097: note = Description of Unknown:uncultivated organism with predicted taxonomy: Firmicutes
  REGION 1..1097: note = MG21-74 effector
MNMESKHYTLGLDIGIASIGWAVLNNNVDGTPDRIIDLGVRLFESAEVQNTGESLAAPRRNARSARRRLRRHRHRLERIRYLLVQQGVLTQEEMTHLYDKCSMLSPYQLRTEGLDRILNAQEFSRVLIHLGQRRGYLSNSTAEEAKNEKENGVIKSAILENQQRMEHGGYRTIGEMMYRDAAFWETINGIRYHCTRNKAGNYHFTVDRASILSEVHILFEAQRRLGSPWASQETEDTYAAILSSQRSFDEGPGGDSPFRKGISERVGNCTLIPTELRAAKADETFEYFKLLQDLNHMRLVDSNGSHPLTQQQRALLEAAAFRTANLTYGQLRKKLGISDEVRFAGLYYGQDSIEKAEKRKWAQMQSYHKIRTALDKVSKDAISMLTQDQLDAIGEIVTAYKADAARIEHLQAAGIPKEYHNALLSLSFSKYGKLSCCAMRKLIPFLQQGMRYDEACKAAGMNFHGANGNVEKLSDFLDEITNPVVRRAVSQTIKVVNAVVRTYGNPDAVRIELAREMSHSFDERNKIKKRQEDGRRKNEQIKAQILETKAGHRVTGLDIVKFKLFQEQDGVCPYSGKALDVQRLYEPGYADVDHIIPYSRCFDDSYSNKVLVLASENRQKGNCTPYEYFGADERRWHEFSVRVGASVRDFKKRQKLLNTSFGEEQGKEFIQRNLNDTQHITRVVYNYLRNNLSFADSTYANAPVQAVSGTVTATLRGRWGIEKMREDGDLHHCKDAVVIAATSPSMIQRLSNYYKEEERLFMGKTHFVDPETGEVLTRKAFQQRFAPKFPQPWDRFREELEARLDPVNPMDAVMALHLSTYEPDEDITPVFVSHMPKHTVTGAAHEETIRGKTETGTVAKTALTALKLDKHGEIEGYYNPQTDPRLYQALVERLKQFGGDGAKAFVEPFYKPKKDGTPGPRVDKVKIAKKASLSVSTGRGVADNGNMVRIDVFHVPDDGYYFVPIYVADTKKAALPSKAVVAHKLPEAWKQMKPEHFLFSLFKGDLIQLENRKGISLLLTKEAIGEKTIQVKSGLFYFCGADISNGSIEIETHDRRYGKKSLGLKTLTAIEKYQVDVLGNVNKVKLPEKRLEFRGRK

SEQ ID NO: 1585 - protein, 1127 aa, unidentified
  REGION 1..1127: note = Description of Unknown:uncultivated organism with predicted taxonomy: Clostridiales
  REGION 1..1127: note = MG21-75 effector
MNYRIGLDLGIASVGWAVLEDDYTGKPKRIVKLGARIFDSAENPKDGSSLALNRRETRETRRRLRRRNHRIKRTKNLLEKYNIMTTKEIENMYATYKFQFNPYELRVKGLDEKLTNSELSRILISFVKRRGYKSNSKSEETNDKEMGKLLTATKENELLMKEKGYRTVGEMYLKDEKFKMQMPDGRVLLKVRNTTDDYKNTPLRKLLLDETKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKAKVTLTYASLRTALNLEGNERFNMIHYKATNVFSDEINKKAEKERKFKEFESYHKMRVAMDKAEKNYILKLSTDELDVIGTVLTLYKNDNKRIEKLAQLNLPENIINEILKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGICVYSGKRISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNICDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKTYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1586 - protein, 1100 aa, unidentified
  REGION 1..1100: note = Description of Unknown:uncultivated organism with predicted taxonomy: Clostridialesbacterium 42_27
  REGION 1..1100: note = MG21-76 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEEYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1587 - protein, 1098 aa, unidentified
  REGION 1..1098: note = Description of Unknown:uncultivated organism with predicted taxonomy: Clostridiales
  REGION 1..1098: note = MG21-77 effector
LSLRYTLGLDIGIASVGWAVLEDNIDGEPIKIERLGVRIFDKAEQPKTGASLAEPRREARGQRRTIRRRRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLKDDRFWECNPDGTKIFVPHNHPDDYRTTVERSMVEDEIRLIFSRQHALGVSYATSEFEEAYLEIWGSQRNFDEGPGAKSPYGGNMIEKMLGHCTFEKDEPRAAKGSYSAEYFRLLQDVNHLRLVKNNGESNALTAEQKQIYIDLVMKSATASYAQLRKKLELSNDVSFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIEPINNPVVRRAVSQTIRVINAVVREYGAPEVVRVELAREMGKPYDVRTQITKKQEANAKKNEEVKQKIREIKGLEPTGQDIVKFKLFQDQNGVCLYSGQSLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHEATIRSAKKPGGSISKKPLTSLSLNKKTGEIEKYYAPESDRLLYEALKKRLKEFDGNAEKAFAEPFYKPKRDGTRGPLVKKVKIYEKKTITVPVGGGNADNGSMIRVDVFYIEGDGYYYVPIYITDVVKDELPNRAVVTQKSHGEWKVMDDKDFLFSMYPHDLIYVERKEAFTLDAPKNSSLDPTISKTKGFFYYRSFDSGTGSFKIYTHDRSYSKKSLGGKTLSCLKKYTVDVLGNYSEVSLPEKRKPLRG

SEQ ID NO: 1588 - protein, 1100 aa, unidentified
  REGION 1..1100: note = Description of Unknown:uncultivated organism with predicted taxonomy: Clostridialesbacterium 42_27
  REGION 1..1100: note = MG21-78 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEEYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1589 - protein, 1100 aa, unidentified
  REGION 1..1100: note = Description of Unknown:uncultivated organism with predicted taxonomy: Clostridiales
  REGION 1..1100: note = MG21-79 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMFRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNNLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRSGQRTNRLSLKDMEEITNPVVRRAVSQTIKVINAVVRTYGPPDVVRIELAREMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRTVYNLIRNHLAFAESAYRKKPVQAVNGAVTAMLRGRWGVQKIREDSDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKIREKATVGLPVRDGIAANGSMVRIDVFYVEDDGYYFVPIYVADTKKESLPNKAVVAYKAYSEWKEMKDENFIFSLYPRDLVCIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1590 - protein, 1100 aa, unidentified
  REGION 1..1100: note = Description of Unknown:uncultivated organism with predicted taxonomy: Clostridiales
  REGION 1..1100: note = MG21-80 effector
MTLQSIRYTLGLDIGIASVGWAVLRNGLDGEPYKIENLGVRIFDKAEVPKTGASLAAPRREARSSRRVVRRRRHRKERIKYLIEQEGIMTQTEMMQLFQNSSFEKSVYEIRVEALDRLLTREEAVRLLIHFAQRRGYKSNSKAEEAKDNENGVIKQAISQNQQSMKEHGYRTFGEMLLMDDRFYYTQPDGARIFIPHNKASDYKVTAERGMLADELHMIFAAQRSLGSLWFSDPFEIAYMDIWSSQRSFDKGPGGDSPYSGNQVEKNWGKCTFEKDKLRAPKASYSAEYFRLLQDVNHLRIVSLDGASFPLNQEQRDTVVVAARKSSSLTYAQLRKKLKLSDDQYFNALYYGDKTTAEVEKKKFGHLQFYRQLRTALDKVEKGAADTLTWEQRDEIARILTVYKADDRRTDELQKAGIPEKYIDALLPLSPTKAMHLSVTAIKKIIPYLEAGMPYSDALSKAYGNQTNASTSSKKHKLSLNDIEEITNPVVRRAVSQSIKVINAIVRQYGAPERVRIELAREMGKNFKDRRMIETRQTDNAAKNERIKAQISEYKSDHITGQDIVKFKLFKEQDGICLYSGKSLDIARLFEPGYVDIDHIIPYSISFDDSYNNKVLVQSSENRQKGNRIPYAYFGQNSDRWEKYETLVNNTVRSYRKRKNLLLKSLSEAQIDGFKQRNLQDTQYLSKVVFRLIEDHLQFAKTAPGKKHTQPVNGAITAQVRKRLGIEKIREDGDLHHAMDAAVIACITPGMIQRITKYAQNHERFYATAKGYVDIKTGEVLTRAQYEAMDDIRFPEPWAGFRLELEARVSDHPQEAIAQLKLPHYENSEEIRPIFVSRMPNHKVTGAAHLETIRSKKGGAGSTVTKTALTELKLGKDGEIAGYCRKEDDPLLYEALKARLKAFGGDGKKAFAEPFHKPKHNGEPGPIVNKVKIQESATLTVPVNHGVAANGSMVRLDVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRLNRRGLGGKTLLSIEKYQVDVLGNYFPVALPEKRMKFR

SEQ ID NO: 1591 - protein, 1100 aa, unidentified
  REGION 1..1100: note = Description of Unknown:uncultivated organism with predicted taxonomy: Clostridiales
  REGION 1..1100: note = MG21-81 effector
MSDFHYALGLDIGIGSVGWAVLRNQPNGEPDRIQDLGVRIFDKAEQPKTGASLAAPRRDARSARRRLRRHRHRLERIRYLMEQHDIMPVSDIQAMYAAGGFEKSPYQLRAEALDRPLSKEELVRVLIHLAQRRGYRSNSTAEAAKNEKETGKVKSAIEENRACMEQHGYRTVGEMMFRDERFWQKHPDGTRCHQTRNKAEDYRFTVERTAIVDEAKQIFTAQRRFGAGWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFHHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHKVTGAAHAETIRSSKMGDGYTVTKTPLANLKLNKFGEIEGYYNPASDTLLYDALLARLKDFGGDGAKAFAEPFYKPKKDGTPGPRVDKVKICEKATTGLPVRDGIAANGSMVRIDVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 1592 - protein, 1100 aa, unidentified
  REGION 1..1100: note = Description of Unknown:uncultivated organism with predicted taxonomy: Clostridialesbacterium 42_27
  REGION 1..1100: note = MG21-82 effector
MSEFHYALGLDIGIGSVGWAVLRNQPNGEPDRIQDLGVRIFDKAEQPKTGASLAAPRRDARSARRRLRRHRHRLERIRYLMEQHGIMPVADIQAMYAASGFQKSPYQLRAEALDRPLTKEEAVRVLIHLAQRRGYKSNSTAEAAKDEKETGKVKTAIEENRRCMAEHSYRTVGEMMYRDERFWQKHPDGTRYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1593 - protein, 878 aa, unidentified
  REGION 1..878: note = Description of Unknown:uncultivated organism with predicted taxonomy: Clostridialesbacterium 42_27
  REGION 1..878: note = MG21-83 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYQFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIE

SEQ ID NO: 1594 - protein, 1100 aa, unidentified
  REGION 1..1100: note = Description of Unknown:uncultivated organism with predicted taxonomy: Clostridiales
  REGION 1..1100: note = MG21-84 effector
MSEFHYALGLDIGIGSVGWAVLRNQPNGEPDRIQDLGVRIFDKAEQPKTGASLAAPRRDARSARRRLRRHRHRLERIRYMMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLSEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1595 - protein, 1138 aa, unidentified
  REGION 1..1138: note = Description of Unknown:uncultivated organism with predicted taxonomy: Clostridiales
  REGION 1..1138: note = MG21-85 effector
LSLRYTLGLDIGIASVGWAVLKNDINGVPIKIEDLGAVAFSAAEPTGKVQKKKSGSKTPAPTLASNLRKIRCPRRTIRRKRHRKDRIKQLIQQNGIMTRVEMAEMFEHSQFETSVYELRVQALERALTKQEFVRVLIHLAQRRGYKSNSESEEAKDKENGKVKIAISENKQCMEKNGYRTIGEMLLNDDRFWEDNHDGTKIFVPHNHPDDYRTTVERSMVEDEIRLIFSRQRALGVPYATSEFEEAYLKIWGGQRNFDDGPGYEIPPKDDGTGGKYSRYGGNMIEKMLGHCTFEKDEPRAAKGSYSAEYFRLLQDVNHLRLVKNNGESSALTAEQKQIYIDLVMESEAASYEEAASYEELREKLGLSNDILFNMLRYGSDEIGKVERKKLGHMKFYHEMRKALNMVQKDAISTVSWEQRDEIARILLCYKSDDKRKAQLEKLDIPQEFILKLLTLSTSKTAHLSVKALRKLIPYLEEGMTYAEACKEVYGEQKISVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQDQNGVCLYSGQNLDITRLFEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYPPRFPAPWERFRQELEARLSDNPAEEIARLHLATYDSEEEIKPVFVSRKPERKTTGAAHKDTIYRKADGGYIDKVPLTKLTLDKKTGEIEKYYAPESDRLLYEALKKRLKEFDGNAKEAFAEPFYKPKRDGTSGPLVKKVKLYEKYNNTVEVKRGDARASNKHIGCARNDSNSMIRVDVFYIEGDGYYYVPIYITDVVKDELPNRAVVTQKSHGEWKVMDDKDFLFSMYPHDLIYVERKEAFTLDALKNSSLDPTISKTKGFFYYRSFDSGTGSFKIYTHDSSYSKKSLGGKTLSCLKKYTVDILGNYSEVSLPEKRKPLRG

SEQ ID NO: 1596 - protein, 1100 aa, unidentified
  REGION 1..1100: note = Description of Unknown:uncultivated organism with predicted taxonomy: Firmicutes
  REGION 1..1100: note = MG21-86 effector
MSDFHYALGLDIGIGSVGWAVLRNRPDGEPDRIQDLGVRIFDKAEQPKTGASLAAPRRDARSARRRLRRHRHRLERIRYLMEQHGIMPVSDIQAMYAAGGFEKSPYQLRAEALDRPLSREELVRVLIHLAQRRGYRSNSTAEAAKNEKETGKVKSAIEENRACMEQHGYRTVGEMMLRDERFWQKHPDGTRCHQTRNKAEDYRFTVERTAIVDEAKQIFTAQRRFGADWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFNHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHKVTGAAHAETIRSSKMGDGYTVTKTPLANLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 1597 - protein, 980 aa, unidentified
  REGION 1..980: note = Description of Unknown:uncultivated organism with predicted taxonomy: Clostridiales
  REGION 1..980: note = MG21-87 effector
EAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRASGITVGAIQIETHDRRYLQPSLGIKTLQSIEKYQVDVLGNYYKVDLPEKRMTFSKEG

SEQ ID NO: 1598 - protein, 1098 aa, unidentified
  REGION 1..1098: note = Description of Unknown:uncultivated organism with predicted taxonomy: Clostridiales
  REGION 1..1098: note = MG21-88 effector
LSLRYTLGLDIGIASVGWAVLENNIDGEPIKIERLGVRIFDKAEQPKTGASLAEPRREARGQRRTIRRRRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLKDDRFWECNPDGTKIFVPHNHPDDYRTTVERSMVEDEIRLIFSRQHALGVSYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKPVFVSRKQTHKISGAAHEATIRSAKKPGGSISKKPLTSLSLNKKTGEIEGYYAPESDRLLYEALKKRLEEFDGNAEKAFAEPFYKPKRDGTRGPLVKKVKIYEKKTITVPVGGGNADNGSMIRVDVFYVEDDGYYYVPIYTADVIKGALPNRAVVAHKSHGEWKVMDDKDFLFSMYPNELLYIESRKGIKLKTKKGSSRQEEIIRKAGLYYFKWLNIAANALFIITHDNGYEQPSLGGKTLSCLKKYTVDALGNYSEVSLPEKRKPLRG

SEQ ID NO: 1599 - protein, 1100 aa, unidentified; identical to SEQ ID NO: 1544
  REGION 1..1100: note = Description of Unknown:uncultivated organism with predicted taxonomy: Clostridiales
  REGION 1..1100: note = MG21-89 effector

SEQ ID NO: 1600 - protein, 1100 aa, unidentified; identical to SEQ ID NO: 1578
  REGION 1..1100: note = Description of Unknown:uncultivated organism with predicted taxonomy: Clostridialesbacterium 42_27
  REGION 1..1100: note = MG21-90 effector

SEQ ID NO: 1601 - protein, 1100 aa, unidentified; identical to SEQ ID NO: 1578
  REGION 1..1100: note = Description of Unknown:uncultivated organism with predicted taxonomy: Clostridialesbacterium 42_27
  REGION 1..1100: note = MG21-91 effector

SEQ ID NO: 1602 - protein, 919 aa, unidentified
  REGION 1..919: note = Description of Unknown:uncultivated organism with predicted taxonomy: Ruminococcaceaebacterium TF06-43
  REGION 1..919: note = MG21-92 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLNPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDG

SEQ ID NO: 1603 - protein, 1100 aa, unidentified; identical to SEQ ID NO: 1544
  REGION 1..1100: note = Description of Unknown:uncultivated organism with predicted taxonomy: Ruminococcaceaebacterium TF06-43
  REGION 1..1100: note = MG21-93 effector

SEQ ID NO: 1604 - protein, 1100 aa, unidentified
  REGION 1..1100: note = Description of Unknown:uncultivated organism with predicted taxonomy: Clostridiales
  REGION 1..1100: note = MG21-94 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1605 - protein, 1036 aa, unidentified
  REGION 1..1036: note = Description of Unknown:uncultivated organism with predicted taxonomy: Clostridialesbacterium 42_27
  REGION 1..1036: note = MG21-95 effector
RRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTHYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1606 - protein, 1100 aa, unidentified; identical to SEQ ID NO: 1578
  REGION 1..1100: note = Description of Unknown:uncultivated organism with predicted taxonomy: Clostridialesbacterium 42_27
  REGION 1..1100: note = MG21-96 effector

SEQ ID NO: 1607 - protein, 1128 aa, unidentified
  REGION 1..1128: note = Description of Unknown:uncultivated organism with predicted taxonomy: Clostridium
  REGION 1..1128: note = MG21-97 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLFKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAVKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIAANGDMIRIDVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 1608 - protein, 1134 aa, unidentified
  REGION 1..1134: note = Description of Unknown:uncultivated organism with predicted taxonomy: Clostridiales
  REGION 1..1134: note = MG21-98 effector
LSLRYTLGLDIGIASVGWAVLKNDINGVPIKIEDLGAVAFSAAEPTGKVQKKKSNSKTPAPTLASNLRKIRCPRRTIRRKRHRKDRIKQLIQQNGIMTRVEMAEMFEHSQFETSVYELRVQALERALTKQELVRVLIHLAQRRGYKSNSKSEEAKDKENGKVKIAISENKQCMEENGYRTIGEMLLNDDRFWEDNHDGTKNFVPHNHPDDYRTTVERSMVEDEIRLIFSRQRALGVPYATSEFEEAYLKIWGGQRNFDDGPGYEIPPKDDGTEGKYSRYGGNMIEKMLGHCTFEKDEPRAAKGSYSAEYFRLLQDVNHLRLVKNNGESSALTAEQKQIYIDLVMKSATASYAKLRKKLDLSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSVKALRKLIPHLEKGMTYAEACKEVYGEQKISVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQEQKGVCLYSGKNIEIDRLFKPEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYSPRFPAPWERFRQELEARLSDNPAEEIARLHLATYDSEEEIKPVFVSRKPKRKTTGAAHKDTIYRKTDGGYIDKVPLTKLTLDKKTGEIEKYYAPESDRLLYEALKKRLEEFDGNAKEAFAEPFYKPKRDGTRGPLVKKVKLYETYNNTVEVKRGDARASNKHIGCARNDSNSMIRVDVFYIEDDGYYYVPIYITDVVKDELPNKAVVQKKLPKDWKEMDDRDFLFSMYPNELLYIESRKGIKLKTKKGSSRQEEIIRKAGLYYFKRLDIASGNLFIITHDHSYEQPSLGGKTLSCLKKYTIDVLGNYSEVSLPEKRKPLRG

SEQ ID NO: 1609 - protein, 1100 aa, unidentified; identical to SEQ ID NO: 1538
  REGION 1..1100: note = Description of Unknown:uncultivated organism with predicted taxonomy: Clostridialesbacterium 42_27
  REGION 1..1100: note = MG21-99 effector

SEQ ID NO: 1610 - protein, 1100 aa, unidentified
  REGION 1..1100: note = Description of Unknown:uncultivated organism with predicted taxonomy: Clostridiales
  REGION 1..1100: note = MG21-100 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVYLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1611 - protein, 1127 aa, unidentified
  REGION 1..1127: note = Description of Unknown:uncultivated organism with predicted taxonomy: Clostridiales
  REGION 1..1127: note = MG21-101 effector
MNYRIGLDLGIASVGWAVLEDDYMGKPKRIVKLGARIFDSAENPKDGSSLALNRREARETRRRLRRRNHRIKRTKNLLEKYNIMTTKEIEDMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKTKVTLTYASLRIALNLAGNERFNMIHYKATNVFSDEINKEAEKERKFKEFESYHKMRVSMDKAEKNYILKLSTDELDVIGTVLTLYKNDNKRIEKLAQLNLPENIINEMLKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNIQDTQYISRLMYNLIKNHVQFSNNENFERKVFTVNGQITSHIGKRLGINKIRENGDEHHATDAVIIATVSQGMIQRITKYYQYIDGRYEKNSGEYIDMETGEIITKEQYEAKNGSNFPEPWPKFRKELDIRTTCKTKARMEECLLTEKIFYDDYDDVKPIFISRMPKRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKLYAEWKEMQDKDFIFSLYPRDLFYVKSKNKIKLTSINKQDKESLETNELFAYYVKAGISTAAIACINHNGEYEQNSLGIKRLQEFKKYEVDVLGNYHEVKLPEKRQDFSNLKKGGSLK

SEQ ID NO: 1612 - protein, 1128 aa, unidentified; identical to SEQ ID NO: 1554
  REGION 1..1128: note = Description of Unknown:uncultivated organism with predicted taxonomy: Clostridium
  REGION 1..1128: note = MG21-102 effector

SEQ ID NO: 1613 - protein, 1100 aa, unidentified
  REGION 1..1100: note = Description of Unknown:uncultivated organism with predicted taxonomy: Clostridiales
  REGION 1..1100: note = MG21-103 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKCPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRSSKGGDGFTVTKTPLTNLKLNKFGEIEGYYNPASDTLLYDSLLARLKDFGGDGAKAFAQPFYKPKKDGTPGPRVDKVKICEKATIGLPVRNGIAANGSMIRIDVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1614 - protein, 1100 aa, unidentified
  REGION 1..1100: note = Description of Unknown:uncultivated organism with predicted taxonomy: Clostridialesbacterium 42_27
  REGION 1..1100: note = MG21-104 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1615 - protein, 1100 aa, unidentified
  REGION 1..1100: note = Description of Unknown:uncultivated organism with predicted taxonomy: Clostridialesbacterium 42_27
  REGION 1..1100: note = MG21-105 effector
MSEFHYALGLDIGIGSVGWAVLRNQPTGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLANLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1616 - protein, 786 aa, unidentified
  REGION 1..786: note = Description of Unknown:uncultivated organism with predicted taxonomy: Oscillibactersp. CAG:241_62_21
  REGION 1..786: note = MG21-106 effector
MLEFHYALGLDIGIGSVGWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQ

SEQ ID NO: 1617 - protein, 1128 aa, unidentified
  REGION 1..1128: note = Description of Unknown:uncultivated organism with predicted taxonomy: Clostridium
  REGION 1..1128: note = MG21-107 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLFKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIVANGDMIRIDVFKVDGEGYYFVPIYVSDTIKSKLPNKACVAAKQYSEWKDMKDENFIFSLYPRDLIYIKSKNKIKLTSINKENKENKEISEMFAYYIKSGISTATISIINHNGEYEQNSLGIKTLKEFKKFEVDVLGNYHEVKLPEKRQSFKNLKKKGGSLK

SEQ ID NO: 1618 - protein, 1100 aa, unidentified; identical to SEQ ID NO: 1544
  REGION 1..1100: note = Description of Unknown:uncultivated organism with predicted taxonomy: Clostridiales
  REGION 1..1100: note = MG21-108 effector

SEQ ID NO: 1619 - protein, 1045 aa, unidentified
  REGION 1..1045: note = Description of Unknown:uncultivated organism with predicted taxonomy: Clostridialesbacterium 42_27
  REGION 1..1045: note = MG21-109 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAG

SEQ ID NO: 1620 - protein, 1100 aa, unidentified
  REGION 1..1100: note = Description of Unknown:uncultivated organism with predicted taxonomy: Oscillibactersp. CAG:241_62_21
  REGION 1..1100: note = MG21-110 effector
MLEFHYALGLDIGIGSVGWAVLRNQENGEPDRIQDLGVRIFDKAEQSKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELCYGDHSREDAEKRKWPQMQSYHKIRTALDKVGKGTISTLTEEQLNAIAEILTRYKSDAKRIAALREAGIPPQLDGALLPLSFSKYGSLSVKAMQKLIPLLEKGQRYDQACTQIYGDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1621 - protein, 1100 aa, unidentified
  REGION 1..1100: note = Description of Unknown:uncultivated organism with predicted taxonomy: Clostridiales
  REGION 1..1100: note = MG21-111 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRRSKGGDGFTVTKTPLTNLKLNKFGEIEGYYNPASDTLLYDSLLARLKDFGGDGAKAFAQPFYKPKKDGTPGPRVDKVKICEKATIGLPVRNGIAANGSMIRIDVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1622 - protein, 1100 aa, unidentified; identical to SEQ ID NO: 1538
  REGION 1..1100: note = Description of Unknown:uncultivated organism with predicted taxonomy: Clostridialesbacterium 42_27
  REGION 1..1100: note = MG21-112 effector

SEQ ID NO: 1623 - protein, 1100 aa, unidentified; identical to SEQ ID NO: 1614
  REGION 1..1100: note = Description of Unknown:uncultivated organism with predicted taxonomy: Clostridialesbacterium 42_27
  REGION 1..1100: note = MG21-113 effector

SEQ ID NO: 1624 - protein, 1028 aa, unidentified
  REGION 1..1028: note = Description of Unknown:uncultivated organism with predicted taxonomy: Clostridialesbacterium 42_27
  REGION 1..1028: note = MG21-114 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKIAIEENRRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVSKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLTFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTG

SEQ ID NO: 1625 - protein, 1107 aa, unidentified
  REGION 1..1107: note = Description of Unknown:uncultivated organism with predicted taxonomy: Clostridiales
  REGION 1..1107: note = MG21-115 effector
LSLRYTLGLDIGIASVGWAVLENNIDGEPIKIERLGVRIFDKAEQPKTGASLAEPRREARGQRRTIRRRRHRKDRIKQLIQQNGIMTRVEMTEMFEHSQFETSVYELRVQALERALTKQEFVRVLIHLAQRRGYKSNSKSEEAKDKENGKVKSAISENKKCMEENGYRTIGEMLLNDDRFWEYNPDGTKIFVPHNHPDDYRTTVERSMVEDEIRLIFSRQHALGVPYATSEFEEAYLEIWGRQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAIATVSWEQRDEIARILLCYKSDDKRKAQLEKLDIPREFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQETNAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQVLSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHKDTIYRKADGGYIDKVPLTRLTLDKQTGEIKNYYAPESDRLLYEALKKRLEEFDGNAEKAFAEPFYKPRRDGTRGPLVKKVKLYETYNNTVEVKRGDARASNKHIGCAKNDSMIRVDVFYMEDDGYYYVPIYTADVIKGVLPNKAVVRNKLPEDWKEMDDRDFLFSMYPNDLLYIESRRGIKLKTKKGSSRQEEIVRKTGLYYFKGLNIATNALFIITHDNGYEQPSLGGKTLSCLKKYTVDALGNYSEVSLPEKRKPLRG

SEQ ID NO: 1626 - protein, 1100 aa, unidentified; identical to SEQ ID NO: 1544
  REGION 1..1100: note = Description of Unknown:uncultivated organism with predicted taxonomy: Clostridiales
  REGION 1..1100: note = MG21-116 effector

SEQ ID NO: 1627 - protein, 1100 aa, unidentified; identical to SEQ ID NO: 1548
  REGION 1..1100: note = Description of Unknown:uncultivated organism with predicted taxonomy: Clostridialesbacterium 42_27
  REGION 1..1100: note = MG21-117 effector

SEQ ID NO: 1628 - protein, 897 aa, unidentified
  REGION 1..897: note = Description of Unknown:uncultivated organism with predicted taxonomy: Clostridialesbacterium 42_27
  REGION 1..897: note = MG21-118 effector
FTVERAAIVDEVRQIFAAQRRLGVVWMDEDMETAYLSVLESQRSFDEGPGGDSPFSGGIGKRVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1629 - protein, 1100 aa, unidentified; identical to SEQ ID NO: 1578
  REGION 1..1100: note = Description of Unknown:uncultivated organism with predicted taxonomy: Clostridialesbacterium 42_27
  REGION 1..1100: note = MG21-119 effector

SEQ ID NO: 1630 - protein, 1100 aa, unidentified
  REGION 1..1100: note = Description of Unknown:uncultivated organism with predicted taxonomy: Ruminococcaceaebacterium TF06-43
  REGION 1..1100: note = MG21-120 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLMNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1631 - protein, 1100 aa, unidentified
  REGION 1..1100: note = Description of Unknown:uncultivated organism with predicted taxonomy: Clostridiales
  REGION 1..1100: note = MG21-121 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATIGLPVRNGIAANGSMIRIDVFYVEDDGYYFVPIYVVDTKKENLPNKAVVAYKAYSDWKEMRDEDFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1632 - protein, 1109 aa, unidentified; identical to SEQ ID NO: 1579
  REGION 1..1109: note = Description of Unknown:uncultivated organism
  REGION 1..1109: note = MG21-122 effector

SEQ ID NO: 1633 - protein, 1100 aa, unidentified; identical to SEQ ID NO: 1538
  REGION 1..1100: note = Description of Unknown:uncultivated organism with predicted taxonomy: Clostridiales
  REGION 1..1100: note = MG21-123 effector

SEQ ID NO: 1634 - protein, 943 aa, unidentified
  REGION 1..943: note = Description of Unknown:uncultivated organism with predicted taxonomy: Clostridialesbacterium 42_27
  REGION 1..943: note = MG21-124 effector
EENRRCMAEHGYRTVGEMMYRDERFWQKHPAGPRYRQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1635 - protein, 1100 aa, unidentified; identical to SEQ ID NO: 1538
  REGION 1..1100: note = Description of Unknown:uncultivated organism with predicted taxonomy: Clostridialesbacterium 42_27
  REGION 1..1100: note = MG21-125 effector

SEQ ID NO: 1636 - protein, 772 aa, unidentified
  REGION 1..772: note = Description of Unknown:uncultivated organism with predicted taxonomy: Clostridialesbacterium 42_27
  REGION 1..772: note = MG21-126 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVAAMLRGRWGVQKIREDGDLHHCLDAAVIAATTPGLVQRLTAYNKHRETWERSPAGYVD

SEQ ID NO: 1637 - protein, 970 aa, unidentified
  REGION 1..970: note = Description of Unknown:uncultivated organism with predicted taxonomy: Clostridialesbacterium 42_27
  REGION 1..970: note = MG21-127 effector
QRRGYKSNSTAEAAKDEKETGKVKTAIEENRRCMAEHGYRTVGEMMYRDERFWQIHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLNEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLNPIDPRHQIDLLKLETYESDEEIKPVFVSRMPNHKVTGAAHAETIRSSKGGDGFTVTKTPLANLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1638 - protein, 964 aa, unidentified
  REGION 1..964: note = Description of Unknown:uncultivated organism with predicted taxonomy: Clostridialesbacterium 42_27
  REGION 1..964: note = MG21-128 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYY

SEQ ID NO: 1639 - protein, 820 aa, unidentified
  REGION 1..820: note = Description of Unknown:uncultivated organism with predicted taxonomy: Clostridialesbacterium 42_27
  REGION 1..820: note = MG21-129 effector
MYRDERFWQKHPDGTRYHQTRNKAEDYRFTVERAAIVDEVRQIFAAQRRLGTVWMDEDMETAYLSILESQRSFDEGPGGDSPFFGGIGERVGACTFEPDEKRAAKATYTFEYFKLLQDLNRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLRPEQRTNRLSLNDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIARNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEGDGYYFVPIYVADTKKESLPNKAVVAYKAYSEWKEM

SEQ ID NO: 1640 - protein, 889 aa, unidentified
  REGION 1..889: note = Description of Unknown:uncultivated organism with predicted taxonomy: Clostridialesbacterium 42_27
  REGION 1..889: note = MG21-130 effector
VDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGAHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1641 - protein, 1100 aa, unidentified; identical to SEQ ID NO: 1614
  REGION 1..1100: note = Description of Unknown:uncultivated organism with predicted taxonomy: Clostridialesbacterium 42_27
  REGION 1..1100: note = MG21-131 effector

SEQ ID NO: 1642 - protein, 1100 aa, unidentified
  REGION 1..1100: note = Description of Unknown:uncultivated organism with predicted taxonomy: Clostridialesbacterium 42_27
  REGION 1..1100: note = MG21-132 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1643 - protein, 1100 aa, unidentified
  REGION 1..1100: note = Description of Unknown:uncultivated organism with predicted taxonomy: Clostridiales
  REGION 1..1100: note = MG21-133 effector
MLEFHYALGLDIGIGSVVWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADDYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1644 - protein, 1100 aa, unidentified; identical to SEQ ID NO: 1614
  REGION 1..1100: note = Description of Unknown:uncultivated organism with predicted taxonomy: Clostridialesbacterium 42_27
  REGION 1..1100: note = MG21-134 effector

SEQ ID NO: 1645 - protein, 1100 aa, unidentified; identical to SEQ ID NO: 1538
  REGION 1..1100: note = Description of Unknown:uncultivated organism with predicted taxonomy: Clostridiales
  REGION 1..1100: note = MG21-135 effector

SEQ ID NO: 1646 - protein, 1018 aa, unidentified
  REGION 1..1018: note = Description of Unknown:uncultivated organism with predicted taxonomy: Clostridiales
  REGION 1..1018: note = MG21-136 effector
LYDKSDMVSPYQLRTEGLDRLLNAREFSKVLIHLAQRRGYQSNSTAEEAKNEKENGIIKTAILENQQRMGRGGYRTIGEMMYRDAAFWETINGIRYHCTRNKAGDYRFTVDRASILAEVSILFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGISDEVRFAGLYYGEDTIEKAEKRKWPQMQSYHKIRTALDKVSKDAIQTLTQDQLDAIGEILAGGVSDAKRINSFCLAGIPEEYHKALLPLSISKRAKLSIAAMRKLIPFLQQGMRYDEACKAAGLDFHGADGKVEKLSDFLNEITNPVVRRAVSQTIKVVKAVVDTYSNRKEMKLDAVRIELAREMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNLNDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHTVTGAAHKETIRGKTETGTAVKTALTSLKLDKNGEIDGYYNPQTDPRLYQALVERLKKFGGDGAKAFAEPFYKPKRDGTPGPRVDKVKIAEKASLSVPTGRGEADNGEMIRIDVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 1647 - protein, 1127 aa, unidentified
  REGION 1..1127: note = Description of Unknown:uncultivated organism with predicted taxonomy: Clostridiales
  REGION 1..1127: note = MG21-137 effector
MNYRIGLDLGIASVGWAVLEDDYTGKPKRIVKLGARIFDSAENPKDGSSLALNRREARETRRRLRRRNHRIKRTKNLLEKYNIMTTKEIENMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKAKVTLTYASLRTALNLESNERFNMIHYKATNVFSDDINKEAEKERKFKEFESYHKMRVAMDKTEKNYILKLSTDELDVIGTVLTLYKNDNKRIEKLAQLNLPENIINEMLKLSFSKVGNLSIKAMKKIILYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNIQDTQYISRLMYNLIKDHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKTYAEWKKMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1648 - protein, 1100 aa, unidentified
  REGION 1..1100: note = Description of Unknown:uncultivated organism with predicted taxonomy: Clostridialesbacterium 42_27
  REGION 1..1100: note = MG21-138 effector
MSEFHYALGLDIGIGSVGWAVLRNQPNGEPDRIQDLGVRIFDKAEQPKTGASLAAPRGDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1649 - protein, 934 aa, unidentified
  REGION 1..934: note = Description of Unknown:uncultivated organism with predicted taxonomy: Clostridiales
  REGION 1..934: note = MG21-139 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKA

SEQ ID NO: 1650 - protein, 1100 aa, unidentified
  REGION 1..1100: note = Description of Unknown:uncultivated organism with predicted taxonomy: Clostridialesbacterium 42_27
  REGION 1..1100: note = MG21-140 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKFLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1651 - protein, 1113 aa, unidentified
  REGION 1..1113: note = Description of Unknown:uncultivated organism with predicted taxonomy: Firmicutes
  REGION 1..1113: note = MG21-141 effector
MKKRKKKKKDKKDCHYTLGLDIGIASIGWAVLGNDEEGKPNRIIDLGVRIFDKAEVENTGESLAAPRRDARSARRRLRRHRHRLERIRYLLVQQGVLTQEEMTHLYDKSDMVSPYQLRTEGLDRLLNAQEFSKVLIHLAQRRGYQSNSTAEEAKNEKENGVIKSAILENQQRMERGGYRTIGEMMYRDAAFWETINGIRYHCTRNKAGDYRFTVDRASILLEVSLLFEAQRRLGSPWASQEMEDAYTAILSSQRSFDEGPGGDSPFRKGIADRVGNCTLEPTEQRAAKADVTFERFKLLQDLNHMRLVDNNGSHPLTQQQRDDLEAAAFHTANLTYGQLRKKLGLSEEVRFAGLYYGTDPIEKAEKRKWAQMQSYHKIRMALDKVSKDAILTLTQDQRDAIGEILTAYKADAARIEHLQSAGIPKEYHNALLSLSFSKYGKLSCCAMRKLIPLLQQGMRYDEACREVYQDHRTKEASEKKQRLSLNDIDEITNPVVRRAVSQTIKVVNAVVRIYGNPDAVRIELAREMSHSFDERNKMKKRQEDGRQENEQVKAQILETKAGDRVTGLDIVKFKLYREQDGVCLYSGKGLDLQRLYEPGYADVDHIIPYSRCFDDSYSNKVLVLASENRQKGNCTPYEYFGENEQRWHEFSVRVGASVRDFKKRQKLLNTSFGEEQGKNFIQRNLNDTQHITRVVYNYLRNNLEFADSAYAKAPVQAVNGAVTAMLRGRWGIEKMRGDGDLHHCKDAVVIAATSPSMIQRLSNYYKEEERLFMGKTHFVDPGTGEVLTRKEFQQRFAPQFPQPWPRFREELEARLDPVNPTEALMALHLSTYEPEEEIKPVFVSHMPKRTVTGAAHEETIRSRTETGTVTKTALTALKLDKNGEIDGYYSPQTDPRLYRALVERLKQFGGEGTKAFAEPFYKPKKDGTPGPRVDKVKIERKSSLSVPTARGVAKNGDMIRMDVFRVPNERKSDDSYYFVPIYVADTKKATLPSKAVVKGKAPEAWKQMKPEHFLFSVFKGDLIYVESKKGISLALAKEAVGEKIIQVKSGLFYFCGADISDGSIKIETHDGRYYKKSLGIKELKAFEKRQVDVLGNVSKVRLPETRLEFRGRK

SEQ ID NO: 1652 - protein, 1061 aa, unidentified
  REGION 1..1061: note = Description of Unknown:uncultivated organism with predicted taxonomy: Clostridialesbacterium 42_27
  REGION 1..1061: note = MG21-142 effector
NYALLYQLDLNEWVWRKERDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1653 - protein, 1040 aa, unidentified
  REGION 1..1040: note = Description of Unknown:uncultivated organism with predicted taxonomy: Clostridialesbacterium 42_27
  REGION 1..1040: note = MG21-143 effector
RSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYWDERFWQKHPDGTRYHQTRNKAEDYRFTVERAAIVDEVRQIFAAQRRLGTVWMDEDMETDYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRKNRLSLTDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGSPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRASGITVGAIQIETHDRRYLQPSLGIKTLQSIEKYQVDVLGNYYKVDLPEKRMTFSKEG

SEQ ID NO: 1654 - protein, 1098 aa, unidentified
  REGION 1..1098: note = Description of Unknown:uncultivated organism with predicted taxonomy: Clostridiales
  REGION 1..1098: note = MG21-144 effector
LSLRYTLGLDIGIASVGWAVLENNIDGEPIKIERLGVRIFDKAEQPKTGASLAEPRREARGQRRTIRRRRHRKDRIKQLIQQNGIMTRVEMAEMFEHLQFETSVYELRVQALERALTKQEFVRVLIHLAQRRGYKSNSKSEEAKDKENGKVKSAISENKKCMEENGYRTIGEMLLNDDRFWECNPDGIKIFVPHNHPDDYRTTVERSMVEDEIQLIFSRQRALGVPYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSVKALRKLIPYLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWKRFETLVNTQVHNWKKKRNLLTQVLSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHEATIRSAKKPGGSISKKPLTSLSLNKKTGEIKDYYAPESDRLLYEALKKRLEEFDGNAEKAFAEPFYKPKHDGTRGPLVKKVKIYEKKTITVPVGGGNADNGSMIRVDVFYMEDDGYYYVPIYTADVIKDELPNKAVVQKKLPEDWKEMDDKDFLFSMYPNELLYIEHRKGIKLKTKKGSSRQEQIVRKAGFYYFKGLNIAANALFIITHDNGYEQPSLGGKTLSCLKKYTVDALGNYSEVSLPEKRKPLRG

SEQ ID NO: 1655 - protein, 1096 aa, unidentified
  REGION 1..1096: note = Description of Unknown:uncultivated organism with predicted taxonomy: Clostridiales
  REGION 1..1096: note = MG21-145 effector
MEGFRYSLGLDIGIASVGFAVIQNDRNGEPIKIERLGVRVFDRAEQPKTGASLALPRRQARGSRRVIRRRRHRKERIKWLIEDSGLMSRPEQDALLGSGAFDKSVYELRVDALDRRLADDEAVRLLIHFAQRRGYKSNSKAEEAKEAAESGKVKSAISANRQRMEENGYRTVGEMLWRDPLFKRTEPDGRQILVVHNQPGEYKVTVERSMLLEELALIFVRQRELGAPWASEQFEVAYTDIWSSQRNFDDGPGGDSPYGGSQISRMLGKCIFEKELDRAPRASFSAEYFRLLQTANNLKIVGRGQPSEFLDEEQRKLFVELAFSSAAATYTQLRKKLDLPDDLYFNHLYYGEKSKEEIEKKKLGMLPFYHRLRTALNKVEKGAIDQLTAAQRDDIAMILLLYKSDDNRTLRLRDAGIPEEYIPAILELSTAKAAHLSLKAMRKLLPYLEQGYTYDKACKEVYGSHDGKKETERTGRLRLDMTDEITNPVVRRAVSQSIKVINAVVRVYGPPETVRIELARELGKTFDERSKQEKRINENAARNEQAREQIREYKSGDSTGLDIVKFKLFQEQNGVCLYSGKNLDISRLFEAGYVDVDHIIPYSISFDDSYSNKVLVLAGENRQKGNRIPYQYFGNDRERWNRFETLVGTQIRSFKKRKNLLIRSLGEAQIEGFRQRNLVDTQYLSRVIFRLIDENMAFAETGNYKRKTQTVSGAITAQVRKRLGIDKIRENGDLHHAADAAVIACISPGMVHKVTNYAKRCELYRDGQGYIDYETGEVMTKEAFDEKYAPRFPEPWPMFRKELEARLSADPRAEIEHLNLPAYDSSDELRPVFVSRMPRHKVTGAAHMETVRSGKLEGKTVTKTALTDLKLVKGEIKGYYRPEDDPLLYDALKARLQAFGGDAKKAFAEPFHKPKHDGAPGPLVKKVKIMDASSLNVPVNGGIAANGSMVRVDVFRVEDDGYYFVPVYVSDTIRTRLPDRAVVANKPYSEWKVMRDEDFVFSLFPGDLIRIKNSRRIKLNAAKGSTGEPVKYVKDALFYFSGLNISTGALGIQLHDRSYGQTGLGGKTLSLIEKYQVDVLGNYAPVHLPEKRMGFR

SEQ ID NO: 1656 - protein, 1521 aa, unidentified
  REGION 1..1521: note = Description of Unknown:uncultivated organism with predicted taxonomy: Bacteroidales
  REGION 1..1521: note = MG22-1 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDRTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVTKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEEFSHRQLNDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1657 - protein, 1542 aa, unidentified
  REGION 1..1542: note = Description of Unknown:uncultivated organism with predicted taxonomy: Bacteroidales
  REGION 1..1542: note = MG22-3 effector
MKNILGLDLGTNSIGWAWIQSKVPQQTDDCPSSSEYLMPDCATIRMAGSRVLPMDGKMLSGFESGLAVSKTKERTTYRMARRVNERFQLRRERLNRVLRILGFLPAHYEACLDRYGKIDEEKNVTIPWVPTADGKRKFLFYASFLEMKERFHEHHPNLEKIPLDWTLYYLRTKALQQAITKEELAWVLHSFNQKRGYNQSRDEVKDEDASQKEEYVKVKVVSVVDSGEKKKGKTSYIVTTESNLQFTTENAAAPSWLDKEREFIVTTKLNPTGLPKMNQEGRIDCTVRIPKEEDWELKKKRTEALIADSHMTVGEYIFHSLLDNPDAKIKGAKVGTIDRHFYKEELIAILKKQAAFHPELKDAERYAECVSALYASNEMHRNILSAWDMPRLIVNDIIFYQRPLKSKKSDIAECPFESRYFMDKEKKLQKQGIKCIPTSHPHFQEYRIWQFLSNLRVLRREVRENGRYMTDVDVSAHYLTDKVKVELYEWLAGKANVKQKELLSKLRMSEKEFRWNYVEDNIYPCGETRSLLSTRLKKAKLPLSLLDSPSSDGSHTFEFELWHILYSVSDLAELRKALRRFARKHDFTAEQQEAFVETFVKCPPFKKDYGAYSDKALVKLLSLMRIGKYWNADRIDTNTRRRIACLLDGEACDSISLRTREKVAERGLQQSIEQFQGLPQSLACYVVYDRHAEASEVVRWESPADLQQFTRQFKQYSLRNPIVEQVVLETLRVVHDLWEEIQKDGGTIDEIHLEMGRDLKNTAEQRARIMRRNRENEMTNFRIKLLLQELHDCQPDIEGIRPYSPSQQELLRLYEETVWESESGKLGGKEASKDIPDDIKKIRDLLSKPSDKPIPQSAIQRYRLWLDQKYLSPYTGRPIPLARLFTADYEIEHIIPRSIFFDDSYANKVICESAVNKLKNNRLGMQFIREMDGRVETVKLGEGRETSILSVDGYVDLVNDLFRNNPRKRNNLLAEEITEDFCHRQLSDTRYIARYIKGILSNIVRQRAADGTLEQEATSKNLIVCTGQITDRVKQDWGLNDVWNHIITPRFERLNRMTGSNDYGEWCCKEGKRYFQTRVPLHLQIGFNKKRIDHRHHAMDAIAIACVNRNVVNYLNNAAAHATDRMDLRMRICRPSGNGQTKKEIRSPWKNFAHDAECALQAITVSFKQNVRIITKATNTYEGYDASGKKVRRCQTSSDHYSIRKPLHKDTVYGEVVLPVVNQVPLKKALLRVNRIVNGKLRKKIQEMQSSGLTDKQIVDFFMKTCADSPEWNSINFKKIEVRAYSNEEGQTRMAAIRTAIDESFSEKVIGSITDVSIQRILLNHLRECNGDSEEAFSPEGIETMNRNIVRLNGGKPHLPIYKVRLGEAMGKKFAVGQRGNKGKKFVITAKNTNLFFAVYANDEGKRSFETIDLHCALEMQKQGSSVAPPINENGDKLLFVLSPNDLVYVPSESELQHDIDSEDLKLDHVFKVVSFSENRCCFVPHSMSSPIAAGFEFNSPNKIEVVSRLGLFEQDKETVSIKNICLPIKMDRLGHLHLVKI

SEQ ID NO: 1658 - protein, 1542 aa, unidentified; identical to SEQ ID NO: 1657
  REGION 1..1542: note = Description of Unknown:uncultivated organism with predicted taxonomy: Bacteroidales
  REGION 1..1542: note = MG22-4 effector

SEQ ID NO: 1659 - protein, 1521 aa, unidentified
  REGION 1..1521: note = Description of Unknown:uncultivated organism with predicted taxonomy: Bacteroidales
  REGION 1..1521: note = MG22-5 effector
MTKSTRNIIGLDLGTNSIGWSWIQQLISPTPTQPSEYIFDGTPIIRMSGSRIIPMPGDVTGSFERGETISKTKDRTANRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKIGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIIDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALLKADRILDKRLKDKIFELRKLYNYSNKQIEEHLTKVCINRPEWKNYDFKKIAVRILSNDADATHIVAIRKPLDETFDEEKIKAITDTGIQKILLNHLRQNDNDPKKAFTPEGIENMNANIVLLNGGKQHLPIYKVRISEKNNGGYFPIGQKGNRSQKYVTTAKDTNLFFAVYADSKGKRSFNMIDLRTAIECRKQGLSVAPSINEKGEKLLFTLSPNDLVYMPSEEEEANGFSIKGNLIKEHIYKMVSATNRQCFFIPHTVADFISRGQEYNVLNKIELAEDGRSIKEHCVPIKVNRLGK

SEQ ID NO: 1660 - protein, 1467 aa, unidentified
  REGION 1..1467: note = Description of Unknown:uncultivated organism with predicted taxonomy: Bacteroidales
  REGION 1..1467: note = MG22-6 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEELSWVLHSFNQKRGYYQSREDITEEEIIVTTSLDTSGKPKLDKEGKIIQSAKTPDEKDRTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAERDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSDIDVRVREKVAKAELCESIGQYQGLQQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQLNDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1661 - protein, 1521 aa, unidentified; identical to SEQ ID NO: 1659
  REGION 1..1521: note = Description of Unknown:uncultivated organism with predicted taxonomy: Prevotella
  REGION 1..1521: note = MG22-7 effector

SEQ ID NO: 1662 - protein, 1521 aa, unidentified
  REGION 1..1521: note = Description of Unknown:uncultivated organism with predicted taxonomy: Bacteroidales
  REGION 1..1521: note = MG22-8 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAERDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSDIDVRVREKVAKAELCESIGQYQGLQQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQLNDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1663 - protein, 1524 aa, unidentified
  REGION 1..1524: note = Description of Unknown:uncultivated organism with predicted taxonomy: Bacteroidales
  REGION 1..1524: note = MG22-9 effector
MTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGRTREVIVTTSLDATGAPKRDKEGNIIQSVKAPEEKDWTLKKIRTENHIDKSKLTVGEYILQTLLEKPNTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHLINENKTSEFLTSEKKEELFEWLAEKDSVSQKTLLGHIGLKVEHYHWNFPEEKTYPCGETRHLIQSRLKKANLLKSFCSLVPENQKKEFELKLWHILYSVSDYNELRKALETFARKTGFTREEQDLFVEFFSSCPPFKKVYGAYSKRAIARLLPLMRLGKYWHEEHIDSATMNRIEHLISGEECNGIDVRVRENIAKFGLNESIEQYQGLPQWLACYVVYNRHSEASEVTKWESPEELDNYIKAFKQYSLRNPIVEQISLETLRVVHDLWAEIQKEGQTIDEIHLEMGRDLKNTAEERSRIFRRNSENEDTNFRIKLLLEEFYTNEEDMEGIRPYSPSQQELLRIYEEGVWQQEKEIPQDIKDIKKKLSSDKDINEITHSDVQRYRIWMDQKYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQLNDTRYIARFMKGFLSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYTVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 1664 - protein, 1521 aa, unidentified
  REGION 1..1521: note = Description of Unknown:uncultivated organism with predicted taxonomy: Bacteroidales
  REGION 1..1521: note = MG22-10 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRAFKQYSLRNPIVEQVSLETLRVVRDLWAELQKECQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILPSIASVNLKKALLKADRILDKRLKDIIFELRKLYNYSNKQIEEHLTKVCINRPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNDLNKEQIYKMVSATNNRCFFIPHTVADFISRGQEYNSVNKIELTEDGRSIKEHCVPLKVNRLGK

SEQ ID NO: 1665 - protein, 933 aa, unidentified
  REGION 1..933: note = Description of Unknown:uncultivated organism with predicted taxonomy: Prevotella
  REGION 1..933: note = MG22-11 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASKLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVL

SEQ ID NO: 1666 - protein, 1102 aa, unidentified
  REGION 1..1102: note = Description of Unknown:uncultivated organism with predicted taxonomy: Prevotella sp.MGM2
  REGION 1..1102: note = MG22-12 effector
LYSSHHVAANSTYPFKTGHNRTPLNPFTTHKTQPYNIMTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELNNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYF

SEQ ID NO: 1667 - protein, 1558 aa, unidentified
  REGION 1..1558: note = Description of Unknown:uncultivated organism with predicted taxonomy: Prevotella
  REGION 1..1558: note = MG22-13 effector
LYSSHHVAANSTYPFKTGQNRTPLNPFTTHKTQPYNIMTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHEELRDKSLYEQCIKALYAQNEVRRNIIAPWSMSDLLIKDILFYHRPLKSKKSQISECPLEFHCYTDKDGETHRQGIKCIPVSHPLFQEYRIWQFISNLRIYEREHFDNGKHFTNVDKTSDFLTSEKKEELYEWLAEKDSVSQKTLLGHLGLKVERYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLSLQKGFNKKRIDHRHHAMDAIAIACVNRSIVNYLNNAAANQTEREDLRRAVCIPERNGQTKRQLRSPWLCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRCFKTIDLRTAIECKKQGLSVAPSVNEKGDKLLFTLSPNDLVYMPSEEEEANGFSIKGNLIKEHIYKMVSANDNRCFFIPHTVVDFISNGEEYNRHNKIELTEDRRSIKEHCVPLKVNRLGK

SEQ ID NO: 1668 - protein, 781 aa, unidentified
  REGION 1..781: note = Description of Unknown:uncultivated organism with predicted taxonomy: Bacteroidesndongoniae
  REGION 1..781: note = MG22-14 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLNKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAERDSVSQKTLLGKIGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTN

SEQ ID NO: 1669 - protein, 822 aa, unidentified
  REGION 1..822: note = Description of Unknown:uncultivated organism with predicted taxonomy: Prevotella sp.MGM2
  REGION 1..822: note = MG22-15 effector
KWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRQKKYVTTAKDTNLFFAVYADSKGKRSYKTIDLRTAIECRKQGLSVAPSVNEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1670 - protein, 1521 aa, unidentified
  REGION 1..1521: note = Description of Unknown:uncultivated organism with predicted taxonomy: Prevotella sp.MGM2
  REGION 1..1521: note = MG22-16 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1671 - protein, 1187 aa, unidentified
  REGION 1..1187: note = Description of Unknown:uncultivated organism with predicted taxonomy: Prevotella
  REGION 1..1187: note = MG22-17 effector
VSTIDRRFYINEINAILKEQEKYHEELRDKSLYEQCIKALYAQNEVRRNIIAPWSMSDMLIKDILFYHRPLKSKKSHISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTEFTLEEQFLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGILEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEEKIKTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1672 - protein, 1283 aa, unidentified
  REGION 1..1283: note = Description of Unknown:uncultivated organism with predicted taxonomy: Bacteroidales
  REGION 1..1283: note = MG22-18 effector
VTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1673 - protein, 1521 aa, unidentified
  REGION 1..1521: note = Description of Unknown:uncultivated organism with predicted taxonomy: Prevotella
  REGION 1..1521: note = MG22-19 effector
MTKNTRNIIGLDLGTNSIGWSWIQQLISPTSTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGKYIFHALLKNPETKIKGAHVSTIDRRFYINEINAILKEQEKYHKELRDKSLYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEKLYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLRVATKATNSYECFDTASGKKIRRHQSNREHYAIRKPLHKDSVYGEVILTSIASVNLKKTLLKAERILDKRLKDKIFELRKLYNYSNKQIEEHLTKVCINRPEWKNYDFKKIAVRILSNDADATHIVAIRKPLDETFDKEKIKTITDTGIQKILKNHLSRYANDPKKAFSPEGIEDMNANIASLNGGKQHLPIYKVRVSEKDNGGYFPIGQKGNRQKKYVTTAKDTNLFFAVYADSKGKRSYKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1674 - protein, 921 aa, unidentified
  REGION 1..921: note = Description of Unknown:uncultivated organism with predicted taxonomy: Prevotella sp.MGM2
  REGION 1..921: note = MG22-20 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLRVGEYIFHALLKNPETKIKGAHVSTIDRRFYINEINAILKEQEKYHEELRDKSIYEQCTQALYAQNEVRRNIIAPWSMKDLLTKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLIPDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIM

SEQ ID NO: 1675 - protein, 1521 aa, unidentified
  REGION 1..1521: note = Description of Unknown:uncultivated organism with predicted taxonomy: Bacteroidales
  REGION 1..1521: note = MG22-21 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHEELRDKTIYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAELCESIEQYQGLPQWLANYVVYNRHSEASEITKWESPDELDKYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTGIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILKNHLSRYAKNPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1676 - protein, 1420 aa, unidentified
  REGION 1..1420: note = Description of Unknown:uncultivated organism with predicted taxonomy: Bacteroidales
  REGION 1..1420: note = MG22-22 effector
MGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEITAILKEQEKYHEELRNKSLYEQCTQALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLRVATKATNSYECFDTASGKRIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSQNDNDPKKAFTPEGIENMNANIVLLNGGKQHLPIYKVRISEKNNGGYFPIGQKGNRHKKYVTTAQDTNLFFAVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1677 - protein, 1533 aa, unidentified
  REGION 1..1533: note = Description of Unknown:uncultivated organism with predicted taxonomy: Bacteroidales
  REGION 1..1533: note = MG22-23 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCSETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEVVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHLAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1678 - protein, 1521 aa, unidentified
  REGION 1..1521: note = Description of Unknown:uncultivated organism with predicted taxonomy: Bacteroidales
  REGION 1..1521: note = MG22-24 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKIAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLANEITEEFSHRQLNDTRYIARFMKGILSNIVREKNADGTLEPEETSKNLIVCSGRITDRVKQDWGLNDIWNHIITSRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKDKIFELRKLYNYSNKQIEEHLTKVCINCLEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1679 - protein, 821 aa, unidentified
  REGION 1..821: note = Description of Unknown:uncultivated organism with predicted taxonomy: Prevotella sp.MGM2
  REGION 1..821: note = MG22-25 effector
AGLCESIEQYQGLPQWLANYVVYNRHSEASEIIKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSATNNRCFFIPHTVADFIS

SEQ ID NO: 1680 - protein, 1521 aa, unidentified
  REGION 1..1521: note = Description of Unknown:uncultivated organism with predicted taxonomy: Bacteroidales
  REGION 1..1521: note = MG22-26 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGKIGLKVEHYHWNYPEEKTYPCGETRHLIQSRLKKANLQKAFHSLISDEQKDCFERGLWHILYSVSDYNELCKALKTFARKTGFTLEEQLLFVEVFSSCPPFKKDYGAYSKRAITKLLPLMRIGKFWHEESIDSTTKNRIEHLISGEECSGIDVRVREKVAKAGLCKSIEQYQGLQQWLANYVVYNRHSEASEITKWESPDELDNYIRSFKQYSLRNPIVEQVSLETLRVVRDLWAELQKEDQTIDEIHLEMGRDLKNTAEERSRIFRRNNENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSINEKGDKLLFTLSPNDLVYMPSEWEEANGFAIDNNLNKEQIYKMVSATNNRCFFIPHTVADFISRGEEYNSHNKIELTEDGRSIKEHCVPLKVNRLGK

SEQ ID NO: 1681 - protein, 1200 aa, unidentified
  REGION 1..1200: note = Description of Unknown:uncultivated organism with predicted taxonomy: Prevotella sp.MGM2
  REGION 1..1200: note = MG22-27 effector
LLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1682 - protein, 822 aa, unidentified; identical to SEQ ID NO: 1669
  REGION 1..822: note = Description of Unknown:uncultivated organism with predicted taxonomy: Bacteroidales
  REGION 1..822: note = MG22-28 effector

SEQ ID NO: 1683 - protein, 1521 aa, unidentified
  REGION 1..1521: note = Description of Unknown:uncultivated organism with predicted taxonomy: Bacteroidales
  REGION 1..1521: note = MG22-29 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKELHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHSPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHKESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKAERIIDKRLKDKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1684 - protein, 751 aa, unidentified
  REGION 1..751: note = Description of Unknown:uncultivated organism with predicted taxonomy: Prevotella sp.MGM2
  REGION 1..751: note = MG22-30 effector
FRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLRVATKATNSYECFDIASGKKIRKHQSNREHYAIRKPLHKDSVYGEVILPSIASVNLKKALLKADRILDKRLKEKIFELRKLYNYSNKQIEEHLTKVCINRPEWKNYDFKKIAVRILSNDADATHIVAIRKPLDETFDEDKIKTITDTGIQKILLNHLRQNDNDPKKAFTPEGIENMNANIVLLNGGKQHLPIYKVRISEKNNGGYFPIGQKGNRSQKYVTTAKDTNLFFAVYADQKGKRSFKTIDLRTAIECRKQGVSVAPSINEKGDKLLFTLSPNDLVYMPSEEEEANGFSIKGNLIKEHIYKMVNASNNRCFFIPHSVADFISKGEEYNALNKIELTEDGRSIKVHCVPLKVNRLGK

SEQ ID NO: 1685 - protein, 1521 aa, unidentified
  REGION 1..1521: note = Description of Unknown:uncultivated organism with predicted taxonomy: Bacteroidales
  REGION 1..1521: note = MG22-31 effector
MTKNTRNIIGLDLGTNSIGWSWIQQLISPTPTQASEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTREKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHSPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALLKADRILDKRLKEKIFELRKLYNYSNKQIEEHLTKVCINCLEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFDMIDLRTAIECWKQGVSVAPSMNEKGDKLLFTLSPKDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1686 - protein, 808 aa, unidentified
  REGION 1..808: note = Description of Unknown:uncultivated organism with predicted taxonomy: Bacteroidales
  REGION 1..808: note = MG22-32 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIDCKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRRALKNLSNSK

SEQ ID NO: 1687 - protein, 1521 aa, unidentified; identical to SEQ ID NO: 1685
  REGION 1..1521: note = Description of Unknown:uncultivated organism with predicted taxonomy: Bacteroidales
  REGION 1..1521: note = MG22-33 effector

SEQ ID NO: 1688 - protein, 797 aa, unidentified
  REGION 1..797: note = Description of Unknown:uncultivated organism with predicted taxonomy: Bacteroidales
  REGION 1..797: note = MG22-34 effector
QTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNIFTRHLKACNGDSKIAFSPQGVEEMNQHIAELNNGNAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1689 - protein, 833 aa, unidentified
  REGION 1..833: note = Description of Unknown:uncultivated organism with predicted taxonomy: Parabacteroidessp. An277
  REGION 1..833: note = MG22-35 effector
MPLRETNFQMQGIKCIPVSNPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHSNERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKK

SEQ ID NO: 1690 - protein, 1533 aa, unidentified
  REGION 1..1533: note = Description of Unknown:uncultivated organism with predicted taxonomy: Bacteroidales
  REGION 1..1533: note = MG22-36 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCSETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEVVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMTFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHLAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1691 - protein, 1502 aa, unidentified
  REGION 1..1502: note = Description of Unknown:uncultivated organism with predicted taxonomy: Bacteroidales
  REGION 1..1502: note = MG22-37 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEDLSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAVHSLISDEQKECFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDTYNNKVICESAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENVLRQIVVSFKQNLRVATKATNSYECFDTTSGKKIRKHQSNREHYAIRKPLHKDSVYGEVILTSIASVNLKKALLNAERILDKRLKEKIFELRKLYNYSNKQIEEHLTKVCINCPEWKNYDFKKIAVRILSNDADATHIVAIRKPLDETFDEDKIKTITDTGIQKILLNHLRQNDNDPKKAFTTEGIENMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEEANGFSIKGNLIKEHIYKMVSANDNRCFFIPHTVAEYCIFLYVFLRLCGQIKEH

SEQ ID NO: 1692 - protein, 1521 aa, unidentified
  REGION 1..1521: note = Description of Unknown:uncultivated organism with predicted taxonomy: Prevotella
  REGION 1..1521: note = MG22-38 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRMPLSLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRPKKYVTTAKDTNLFFAVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 1693 - protein, 1558 aa, unidentified
  REGION 1..1558: note = Description of Unknown:uncultivated organism with predicted taxonomy: Prevotella sp.MGM2
  REGION 1..1558: note = MG22-39 effector
LYSSHHVAANSTYPFKTGHNRTPLNRFTTHKTQPYNIMTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKIIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHFINEDKTSDFLTTKKKEELYEWLAERDSVSQKTLLGKIGLKVEHYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEIIKWESPDELDNYIRSFKQYSLRNPIVEQVSLETLRVVRDLWTELRKEGQTIDEIHLEMGRDLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSANNKQCFFIPHTVADFISRGEEYNSHNKIELTEDRRSIKEHCVPLKVNRLGK

SEQ ID NO: 1694 - protein, 1532 aa, unidentified
  REGION 1..1532: note = Description of Unknown:uncultivated organism with predicted taxonomy: Bacteroidales
  REGION 1..1532: note = MG22-40 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASKLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLSESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHIAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1695 - protein, 1521 aa, unidentified
  REGION 1..1521: note = Description of Unknown:uncultivated organism with predicted taxonomy: Bacteroidales
  REGION 1..1521: note = MG22-41 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKAWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDIRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALQQIVVSFKQNLRVATKATNSYECFDTASGKKIRKHQSNREHYAIRKALHKDSVYGEVILTSIASVYLKKALLKAERILDKRLKEKIFELRKLYNYSNKQIEEHLTKVCINCPEWKNYDFKKIAVRILSNDADATHIVAIRKPLDETFDKEKIKAITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1696 - protein, 1521 aa, unidentified; identical to SEQ ID NO: 1678
  REGION 1..1521: note = Description of Unknown:uncultivated organism with predicted taxonomy: Prevotella
  REGION 1..1521: note = MG22-42 effector

SEQ ID NO: 1697 - protein, 1423 aa, unidentified
  REGION 1..1423: note = Description of Unknown:uncultivated organism with predicted taxonomy: Bacteroidales
  REGION 1..1423: note = MG22-43 effector
MGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGRTREVIVTTSLDATGAPKRDKEGDIIQSVKAPEEKDWTLKKIRTENHIDKSKLTVGEYILQTLLEKPDTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHLINENKTSEFLTSEKKEELFEWLAEKDSVSQKTLLGHIGLKVEHYHWNFPEEKTYPCGETRHLIQSRLKKANLLKSFCSLVPEKQKKEFELKLWHILYSVSDYNELRKALETFARKTGFTREEQDLFVEFFSSCPPFKKVYGAYSKRAIARLLPLMRLGKYWHEEHIDSATMNRIEHLISGEECNGIDVRVRENIAKFGLNESIEQYQGLPQWLACYVVYNRHSEASEVTKWESPEELDNYIKAFKQYSLRNPIVEQISLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKDVQILKEEEYVELVDKIFGNNTRKRNIMLADEITEEFSHRQLNDTRYIARFMKGILSNIVREKNADGTLESEETSKNLIVCSGRITDRVKQDWGLNDIWNHIITPRFERLNTKTSSDKFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYAVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVANFISRGEEYNRHNKIELTEDRRSIKEHCVPLKVNRLGKKTL

SEQ ID NO: 1698 - protein, 1521 aa, unidentified
  REGION 1..1521: note = Description of Unknown:uncultivated organism with predicted taxonomy: Bacteroidales
  REGION 1..1521: note = MG22-44 effector
MTKNTRNIIGLDLGTNSIGWSWIQQLISPTPTQPSEYLFDGTPIIRMSGSRIIPMHGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKNNGGYFPIGQKGNRPKKFVTTAQDTNLFFAVYADSKGKRSFKTIDLRTAIECKKQGLSVAPSVNEKGDKLLFTLSPNDLVYMPSEEEEANGFAIKGNLIKEHIYKMVNASNNRCFFIPHSVADFISKGEEYNALNKIELTEDGRSIKVHCVPLKVNRLGK

SEQ ID NO: 1699 - protein, 1521 aa, unidentified
  REGION 1..1521: note = Description of Unknown:uncultivated organism with predicted taxonomy: Bacteroidales
  REGION 1..1521: note = MG22-45 effector
MTKNTRNIIGLDLGTNSIGWSWIQQLISPTPTQPSEFLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKQTVGEYIFHALLKNPETKMKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERSLWHILYSVSDYNELCKALKTFARKTGFTLEEQSLFGEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLHIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEEKIKTITDTGIQKILLNHLSRYADDPKKAFSPEGIEDMNANIASLNGGKQHLPIYKVRVSEKDNGGYFPIGQKGNRPKKYVTTAQDTNLFFAVYADSKGKRSYKTIDLRTAIECRKQGLSVAPSINEKGDKLLFTLSPNDLVYMPSEGEEANGFAIDNNLNKEQIYKMVSANNKQCFFIPHTVADFISNGEEYNRHNKIELTEDRRSIKEHCVPLKVNRLGK

SEQ ID NO: 1700 - protein, 1532 aa, unidentified
  REGION 1..1532: note = Description of Unknown:uncultivated organism with predicted taxonomy: Bacteroidales
  REGION 1..1532: note = MG22-46 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFTKVAVRVWSNDEEGSRMVSVRKAIDESFDMKQIEKVYDPIVRNILTRHLKACNGDSKIAFSPQGVEEMNQHIAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1701 - protein, 1521 aa, unidentified
  REGION 1..1521: note = Description of Unknown:uncultivated organism with predicted taxonomy: Bacteroidales
  REGION 1..1521: note = MG22-47 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISDCPLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRAFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1702 - protein, 1532 aa, unidentified; identical to SEQ ID NO: 1700
  REGION 1..1532: note = Description of Unknown:uncultivated organism with predicted taxonomy: Bacteroidales
  REGION 1..1532: note = MG22-48 effector

SEQ ID NO: 1703 - protein, 1521 aa, unidentified
  REGION 1..1521: note = Description of Unknown:uncultivated organism with predicted taxonomy: Bacteroidales
  REGION 1..1521: note = MG22-49 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCKSIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFAKDAENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINRPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVNRLGK

SEQ ID NO: 1704 - protein, 1521 aa, unidentified
  REGION 1..1521: note = Description of Unknown:uncultivated organism with predicted taxonomy: Bacteroidales
  REGION 1..1521: note = MG22-50 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYARALDRYGKLNEESNTTIAWRSKEDGNNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQKEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1705 - protein, 1301 aa, unidentified
  REGION 1..1301: note = Description of Unknown:uncultivated organism with predicted taxonomy: Prevotellaceae
  REGION 1..1301: note = MG22-51 effector
LVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1706 - protein, 941 aa, unidentified
  REGION 1..941: note = Description of Unknown:uncultivated organism with predicted taxonomy: Prevotella sp.MGM2
  REGION 1..941: note = MG22-52 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLYNPQNEAFRLSITNRIISYSSFGFRL

SEQ ID NO: 1707 - protein, 1521 aa, unidentified
  REGION 1..1521: note = Description of Unknown:uncultivated organism with predicted taxonomy: Bacteroidales
  REGION 1..1521: note = MG22-53 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIEKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLTDEITEEFSHRQLNDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1708 - protein, 1569 aa, unidentified
  REGION 1..1569: note = Description of Unknown:uncultivated organism with predicted taxonomy: Bacteroidales
  REGION 1..1569: note = MG22-54 effector
YGLLTHKQLCVLYSSHHVAANSTYPFKTGHNRTPLNRFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECPLEFHTYTDKNGVTHRQGIKCIPTSHPLFQEYRIWQFIANLRIYERERFDNGKHLINEDKTSDFLTTKKKEELYEWLAEKDSVSQKTLLGHLGLKVERYHWNYPEEKTYPCGETRHLIQSRLKKANLQKAFHSLISEEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLPLWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1709 - protein, 1614 aa, unidentified
  REGION 1..1614: note = Description of Unknown:uncultivated organism with predicted taxonomy: Bacteroidales
  REGION 1..1614: note = MG22-55 effector
TNIFQKAKPFHNKFTTFVNVSIQRAVLEYQVGLYNNSFFKKATRCYGLLTHKQLCVLYSSHHVAANSTYPFKTGHNRTPLNRFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECPLEFHTYTDKNGVTHRQGIKCIPTSHPLFQEYRIWQFIANLRIYERERFDNGKHLINEDKTSDFLTTKKKEELYEWLAEKDSVSQKTLLGHLGLKVERYHWNYPEEKTYPCGETRHLIQSRLKKANLQKAFHSLISEEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLPLWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1710 - protein, 1347 aa, unidentified
  REGION 1..1347: note = Description of Unknown:uncultivated organism with predicted taxonomy: Bacteroidales
  REGION 1..1347: note = MG22-56 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMAAIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEELYEWLAERDSVSQKTLLGKIGLKVEDYHWNFPEEKTYPCGETRHLIQSRLKKANLQKTFHSLISDEQKECFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRAFKQYSLRNPIVEQVSLETLRVVLDLWAELQKEGQTIDEIHLEMGRDLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKVKINTITDTGIQKILLNHLSRYADDPKKAFSPEGIEDMNANIASLNGE

SEQ ID NO: 1711 - protein, 1558 aa, unidentified
  REGION 1..1558: note = Description of Unknown:uncultivated organism with predicted taxonomy: Bacteroidales
  REGION 1..1558: note = MG22-57 effector
LYSSHHVAANSTYPFKTGHNRTPLNRFTTHKTQPYNIMTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLENPETKIKGAHVSTIDRRFYINEINAILKEQEKYHEELRDKSIYEQCIKALYAQNEVRRNIIAPWSMKDLLTKDILFYHRPFKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSRQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVYIPERNGQTKRQLRSPWHCFARDAENALRQIVVSFKQNLRVATKATNSYECFDTASGKKIRKHQSNREHYAIRKPLHKDSVYGEVILPSIASVNLKKALMKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 1712 - protein, 1558 aa, unidentified
  REGION 1..1558: note = Description of Unknown:uncultivated organism with predicted taxonomy: Bacteroidales
  REGION 1..1558: note = MG22-58 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMDRRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGETHRQGIKCIPVSHPLFQEYRIWQFISNLRIYEREHFDNGKHFTNVDKTSEFLTSEKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYNTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1713 - protein, 1521 aa, unidentified
  REGION 1..1521: note = Description of Unknown:uncultivated organism with predicted taxonomy: Bacteroidales
  REGION 1..1521: note = MG22-59 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPIKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLRVATKATNSYECFDTASGKRIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSQNDNDPKKAFTPEGIENMNANIVLLNGGKQHLPIYKVRISEKNNGGYFPIGQKGNRHKKYVTTAQDTNLFFAVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1714 - protein, 1521 aa, unidentified
  REGION 1..1521: note = Description of Unknown:uncultivated organism with predicted taxonomy: Bacteroidales
  REGION 1..1521: note = MG22-60 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYVRALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1715 - protein, 1521 aa, unidentified
  REGION 1..1521: note = Description of Unknown:uncultivated organism with predicted taxonomy: Bacteroidales
  REGION 1..1521: note = MG22-61 effector
MTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAHSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILMEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQIEREDLRRAVCIPERNGQTKRQLRSPWHCFARDAENALRQIVVSFKQNLRIATKATNSYECFDTASGKKNRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNGGKQHLPIYKVRVSEKDNGGYFPIGQKGNRPKKYVTTAKDTNLFFAVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 1716 - protein, 1558 aa, unidentified
  REGION 1..1558: note = Description of Unknown:uncultivated organism with predicted taxonomy: Bacteroidales
  REGION 1..1558: note = MG22-62 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1717 - protein, 913 aa, unidentified
  REGION 1..913: note = Description of Unknown:uncultivated organism with predicted taxonomy: Parabacteroides
  REGION 1..913: note = MG22-63 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWYEESIDSTTKNRIEHLISGEECSSIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNN

SEQ ID NO: 1718 - protein, 1450 aa, unidentified
  REGION 1..1450: note = Description of Unknown:uncultivated organism with predicted taxonomy: Prevotella sp.MGM2
  REGION 1..1450: note = MG22-64 effector
MTKNIRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKQTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRSYKTIDLRTAIECKKQGLSVAPSVNEKGDKLLFTLSRRTRQTLWSRPCRC

SEQ ID NO: 1719 - protein, 1521 aa, unidentified
  REGION 1..1521: note = Description of Unknown:uncultivated organism with predicted taxonomy: Prevotella
  REGION 1..1521: note = MG22-65 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLENPETKIKGAYVSTIDRRFYINEINAILKEQEKYHEELRDKSIYEQCIKALYAQNEVRRNIITPWSMKDLLTKDILFYHRPLKSKKSQISECPLEFHCYTDKDGETHRQGIKCIPVSHPLFQEYRIWQFISNLRIYEREHFDNGKHFTNVDKTSDFLTTKKKEELFEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLQQWLANYVVYNRHSEASEIIKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLRVATKATNSYECFDTASGKKIRKHQSNREHYAIRKPLHKDSVYGEVILTSIASVYLRKALLKAERILDKRLKEKIFELRKLYNYSNKQIEEHLTKVCINCPEWKNYDFKKIAIRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECRKQGLSVAPSINEKGEKLLFTLSPNDLVYMPSEEEEANGFSIKDNLIKEHIYKMVSATNRQCFFIPHTVADFISRGQEYNVLNKIELAEDGRSIKEHCVPIKVNRLGK

SEQ ID NO: 1720 - protein, 1053 aa, unidentified
  REGION 1..1053: note = Description of Unknown:uncultivated organism with predicted taxonomy: Prevotella sp.MGM2
  REGION 1..1053: note = MG22-66 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLEMLRVVRNLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCS

SEQ ID NO: 1721 - protein, 938 aa, unidentified
  REGION 1..938: note = Description of Unknown:uncultivated organism with predicted taxonomy: Bacteroidales
  REGION 1..938: note = MG22-67 effector
MTKNTRNIIGLDLGTNSIGWSWIQQLISPTPTQASEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETLRQGIKCIPVSHPLFQEYRIWQFISNLRIYEREHFDNGKHFTNVDKTSEFLTSEKKEELYEWLAERDSVSQKTLLGKIGLKVEDYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTAKRYHCPVFSPPTTKSNTSFRVHGILTTPIIIRSSAKLPSTKTKTTDWAWNTSWLLEEKRLNSATGKTFKF

SEQ ID NO: 1722 - protein, 1521 aa, unidentified; identical to SEQ ID NO: 1714
  REGION 1..1521: note = Description of Unknown:uncultivated organism with predicted taxonomy: Bacteroidales
  REGION 1..1521: note = MG22-68 effector

SEQ ID NO: 1723 - protein, 1521 aa, unidentified
  REGION 1..1521: note = Description of Unknown:uncultivated organism with predicted taxonomy: Bacteroidales
  REGION 1..1521: note = MG22-69 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEITAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAITIACVNRSIVNYLNNAAANQTEREDLRRAVCIPERNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1724 - protein, 1520 aa, unidentified
  REGION 1..1520: note = Description of Unknown:uncultivated organism with predicted taxonomy: Bacteroidales
  REGION 1..1520: note = MG22-70 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELFEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADTTHIVAIRKPLDETFDEEKIKAITDTGIQKILLNHLRQNDNDPKKAFTPEGIENMNANIVLLNGGKQHLPIYKVRISEKNNGGYFPIGQKGNRSQKYVTTAKDTNLFFAVYADQKGKRSFKTIDLRTAIECRKQGVSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1725 - protein, 1225 aa, unidentified
  REGION 1..1225: note = Description of Unknown:uncultivated organism with predicted taxonomy: Bacteroidales
  REGION 1..1225: note = MG22-71 effector
VGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQCIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1726 - protein, 1521 aa, unidentified
  REGION 1..1521: note = Description of Unknown:uncultivated organism with predicted taxonomy: Bacteroidales
  REGION 1..1521: note = MG22-72 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVDYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKTIYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELRKEGQTIDEIHLEMGRDLKNTAEERSRIFRRNSENEDTNFRIKLLLEKFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1727 - protein, 1345 aa, unidentified
  REGION 1..1345: note = Description of Unknown:uncultivated organism with predicted taxonomy: Prevotella sp.MGM2
  REGION 1..1345: note = MG22-73 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLN

SEQ ID NO: 1728 - protein, 1283 aa, unidentified; identical to SEQ ID NO: 1672
  REGION 1..1283: note = Description of Unknown:uncultivated organism with predicted taxonomy: Bacteroidales
  REGION 1..1283: note = MG22-74 effector

SEQ ID NO: 1729 - protein, 1524 aa, unidentified
  REGION 1..1524: note = Description of Unknown:uncultivated organism with predicted taxonomy: Bacteroidales
  REGION 1..1524: note = MG22-75 effector
MTKNTRNIIGLDLGTNSIGWSWIQQLISPTPTQPSEYLFDETPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGHTREVIVTTSLDATGAPKRDKEGDIIQSVKAPEEKDWTLKKIRTENHIDKSKLTVGEYILQTLLEKPDTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHFINEDKTSDFLTTKKKEELFEWLTEKDSVSQKTLLGHIGLKVEHYHWNFPEEKTYSCGETRHLIQSRLKKANLLKSFCSLVPENQKKEFELKLWHILYSVSDYNELRKALETFARKTGFTREEQDLFVEFFSSCPPFKKIYGAYSKRAIARLLPLMRLGKYWHEEHIDSATMNRIEHLISGEECNGIDVRVRENIAKFGLNQSIEQYQGLPQWLACYVVYNRHSEASEVTKWESPEELDNYIKAFKQYSLRNPIVEQISLETLRVVHDLWAEIQKEGQTIDEIHLEMGRDLKNTAEERARISKRNSENEDTNFRIKLLLKEFYTNEEDMEGIRPYSPSQQELLRIYEEGVWQQEKEIPQDIKDIKKKLSSDKDINEITHSDVQRYRIWMDQEYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQLNDTRYIARFMKGILSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAIDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYAVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 1730 - protein, 1132 aa, unidentified
  REGION 1..1132: note = Description of Unknown:uncultivated organism with predicted taxonomy: Bacteroidales
  REGION 1..1132: note = MG22-76 effector
MSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKECFERGLWHILYSISDYNELCKALKTFARKTGFTLEEQSLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEDFSHRQLNDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNHEHYAIRKPLHKDSVYGEIILPSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1731 - protein, 1521 aa, unidentified; identical to SEQ ID NO: 1692
  REGION 1..1521: note = Description of Unknown:uncultivated organism with predicted taxonomy: Prevotella
  REGION 1..1521: note = MG22-77 effector

SEQ ID NO: 1732 - protein, 1420 aa, unidentified; identical to SEQ ID NO: 1676
  REGION 1..1420: note = Description of Unknown:uncultivated organism with predicted taxonomy: Bacteroidales
  REGION 1..1420: note = MG22-78 effector

SEQ ID NO: 1733 - protein, 1521 aa, unidentified
  REGION 1..1521: note = Description of Unknown:uncultivated organism with predicted taxonomy: Bacteroidales
  REGION 1..1521: note = MG22-79 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMSDMLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTEFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIRKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDTENALRQIVVSFKQNLRITTKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAQDTNLFFAVYVDSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1734 - protein, 1558 aa, unidentified
  REGION 1..1558: note = Description of Unknown:uncultivated organism with predicted taxonomy: Bacteroidales
  REGION 1..1558: note = MG22-80 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKKPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDSVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSANDNRCFFIPHTVADFISNGEEYNRHNKIELTEDRRSIKEHCVPLKVNRLGK

SEQ ID NO: 1735 - protein, 1533 aa, unidentified
  REGION 1..1533: note = Description of Unknown:uncultivated organism with predicted taxonomy: Bacteroidales
  REGION 1..1533: note = MG22-81 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1736 - protein, 1521 aa, unidentified; identical to SEQ ID NO: 1719
  REGION 1..1521: note = Description of Unknown:uncultivated organism with predicted taxonomy: Prevotella
  REGION 1..1521: note = MG22-82 effector

SEQ ID NO: 1737 - protein, 1521 aa, unidentified
  REGION 1..1521: note = Description of Unknown:uncultivated organism with predicted taxonomy: Prevotella
  REGION 1..1521: note = MG22-83 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKNGATHRQGIKCIPTSHPLFQEYRIWQFIANLRIYERERFDNGKHLINEDKTSDFLTTKKKEELFEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRAFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALMKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 1738 - protein, 1558 aa, unidentified
  REGION 1..1558: note = Description of Unknown:uncultivated organism with predicted taxonomy: Bacteroidales
  REGION 1..1558: note = MG22-84 effector
LYSSHHVATNSTYPFKTGHNRTPLNRFTTHKTQPYNIMTKNTRNIIGLDLGTNSIGWSWIQQLISPTSTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEKLYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDTENALRQIVVSFKQNLRVATKATNSYECFDTASGKKIRKHQSNHEHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDKVKINTITDTGIQKILLNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1739 - protein, 1521 aa, unidentified
  REGION 1..1521: note = Description of Unknown:uncultivated organism with predicted taxonomy: Prevotella
  REGION 1..1521: note = MG22-85 effector
MTKNTRNIIGLDLGTNSIGWSWIQQLISPTPTQPSEYFFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHIINEDKTSDFLTTKKKEELFEWLAEKDSVSQKTLLGHLGLKVERYHWNFPEEKTYPCGETRHLIQSRLKKANLQKAFHSLISDEQKDCFERSLWHILYSVSDYNELCKALKTFARKTGFTLEEQSLFVEAFSSCPPFKKDYGAYSKRAITKLLPLMRIGKFWHEESIDSTTKNRIEHLISGDECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITQRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILPSIASVNLKKALLKAERILDKRLKDKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1740 - protein, 985 aa, unidentified
  REGION 1..985: note = Description of Unknown:uncultivated organism with predicted taxonomy: Bacteroidales
  REGION 1..985: note = MG22-86 effector
MKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEETNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAINKDKNNRLGMEYIMAAGGKTIELGNGKDVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRSKKYVTTAKDTNLFFAVYANSNGKRCFKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1741 - protein, 935 aa, unidentified
  REGION 1..935: note = Description of Unknown:uncultivated organism with predicted taxonomy: Prevotella sp.MGM2
  REGION 1..935: note = MG22-87 effector
YQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELREKSLYEQCIKALYAQNEVRRNIIAPWSMSDLLIKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSQRQLNDTRYIARFMKGILSNIVREKNADGTLEPEETSKNLIVCSGRITDRVKQDWGLNDIWNHIVTPRFERLNTKTSSNDFGEYVCKEGKQYFQTRVPLNLQKGFNKKRIDHRHHAMDAIAIACVNRSIVNYLNNAAANQIEREALRRAVCIPERNGQTKR

SEQ ID NO: 1742 - protein, 1521 aa, unidentified
  REGION 1..1521: note = Description of Unknown:uncultivated organism with predicted taxonomy: Prevotella sp.MGM2
  REGION 1..1521: note = MG22-88 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIEKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1743 - protein, 884 aa, unidentified
  REGION 1..884: note = Description of Unknown:uncultivated organism with predicted taxonomy: Prevotella sp.MGM2
  REGION 1..884: note = MG22-89 effector
LLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAIRILSNDADATHIVAIRKPLDESFDKVKINTITDTGIQKILLNHLSRYADDPKKAFSPEGIEDMNANIASLNGGKQHLPIYKVRASEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNVDNSAKIR

SEQ ID NO: 1744 - protein, 1558 aa, unidentified
  REGION 1..1558: note = Description of Unknown:uncultivated organism with predicted taxonomy: Bacteroidales
  REGION 1..1558: note = MG22-90 effector
LYSSHHVAANSTYPFKTGHNRTPLNRFTTHKTQPYNIMTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEDLYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRIATKATNSYECFDTASGKKIRKHQSNHEHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKNNGGYFPIGQKGNRPKKYVTTAQDTNLFFAVYADQKGKRSFKTIDLRTAIECRKQGLSVAPSINEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1745 - protein, 1521 aa, unidentified
  REGION 1..1521: note = Description of Unknown:uncultivated organism with predicted taxonomy: Prevotella
  REGION 1..1521: note = MG22-91 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMAFIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEALLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIGKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIVRFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1746 - protein, 1558 aa, unidentified; identical to SEQ ID NO: 1667
  REGION 1..1558: note = Description of Unknown:uncultivated organism with predicted taxonomy: Bacteroidales
  REGION 1..1558: note = MG22-92 effector

SEQ ID NO: 1747 - protein, 750 aa, unidentified
  REGION 1..750: note = Description of Unknown:uncultivated organism with predicted taxonomy: Bacteroides
  REGION 1..750: note = MG22-93 effector
LGPNSIGWAVVEREEKSSDNSSLFTGGKILMAGSRIIPMSADILNNYEKGVSVSQTSERTKYRQVRRQYERFHQRRERLNRVLQELGFLPAHYSEQLDRYGKLPKGKEPKIAWRPTADGKYEFIFRSSFLEMMAEIRKSHPECKQIPYDWTLYYLRKKALYEKLTPEELSWVLHSFNQKRGYNAVRGQVEEDTETPDKLQEYRKSCLIGLEDTGEKTRGTNVYKLSFEDGTVFEMPLRKINFAVGDEVEFFITTRLDEDGTPKLNKQGLPVISYKIPNADDAWTLNKLRAEFTIDQSCSTVGQYIYDAILRNPQQKIRGELVRTVDRRFYRDELNRILDKQISLHPILQDDNKLQECLLALYPSNEAHRCTMSGRGFKALFMDDVILYQRPLKSKKSLIDACKYEFHTYINKDGKHEKSVLRCASRSNPLFQEFRLWQFIENLRIYKRKDLSDGHLLTDVDVTGKYLSDEDVRVALFDWMRDRSDVDQKSLLKYFKLSESDFRWNYVEDRKYPASETRAEMLKRLKKAGVPTDFLNLENEMALWEIFYSINEKKELEKALSSFARKHNFEVEKFIQSFRTIKPYPSDYCAYSTKALRRLLPLMRQGKYWKEEEIDDQTRSRIQRLIDGEWDEGIAEKVREKTVSLRCESDFRGLPVWLASYVVYNRHSEASEIKKWESPEEMDADIRKFRQHSLRNPIVEQVCLETLRVVRDIWKEEGISMKSTWRWDVKCGLQQRNAKRVAAYKWKTSR

SEQ ID NO: 1748 - protein, 1496 aa, unidentified
  REGION 1..1496: note = Description of Unknown:uncultivated organism with predicted taxonomy: Prevotella
  REGION 1..1496: note = MG22-94 effector
MKNILGLDLGPNSIGWAVVQTEKEGAEESLFAQGKILMAGSRIIPMDASTLGDFEKGNSTSQTADRTKFRQVRRQYERFHQRRERLNRVLLTLDYLPEHYAKELDRYGKLPKEGEPKLAWRPTPDGAYEFLFRDAFLEMVSEFKKHHPELKQIPYDWTIYYLRKKALRQALTPHELSWVLHSFNQKRGYNAVRGKEDKETESPDKRQEYHKSVLTSISDTGEKLRGNVVYRLAFSDGATFDVAGRHISLSEGEEVEYIKTTKLDEDGMPKLTRQGVPDVSYKIPNADDAWTLNKLRAEFTIEQSGTTVGEYIYDAILRNPGQKIRGELVRTIDRRFYRDELCRILDTQIPLHPVLQDGNKLEECLQTLYPNNEAHRLSMLGRGFKGLFMDDVILYQRPLKSKKSLIDDCKYESRTYVNQDGARVRVGLKCASRSHPLFQEYRLWQFMENLRILKRKEFVDGHLRTNVDVTGHHLPDENSRVALFDWLYGRATVDQKALLKYLHLSEEEYSWNYVEERDYPAAETRAEMQKRLKKAGISADFLTPEREMALWEILYSVGVQGELEKALRRFASKHGVDADKFCQSFRTIKPYPADYCAYSTKALRRLLPLMRQGRYWSLSAIDPQTRQRMQRLIDGEWDEGISDRVREKTSDLRHETDFRGLTSWMATYVVYNRHSEAADIKKWHTPEEMDADIRRFRQHSLRNPIVEQVCLEALRTVRDIWKEIGKIDEIHVEMGRNMRATAKERQKTSQLQLENEQANLRIKALLQEFMNPEFEVEDVRPYSPSQQELLRIYEGTVLEQEAGHIDEPIREIIRKFSQTDAAKRPTTSEVLRYKLWLEQKYRSPYTGEVIPLGKLFTPAYQIEHVIPQSLYYDNSFNNKVICEAEVNLLKGNQLGMPFIMRHANEKVVCSMGKQVKIFTPEAYRLFVEEHYRGRKMTILLSEEIPTAFNDRQKNDTRYISRYIIGELSKLVREEKPDGTLEQEPTSKNVVVLNGSVTDKLKKDWGLVDVWNEIITPRFRRLNEMEGSQRFGQDAEKGGKRYFQITMPLELQRGFQRKRIDHRHHAMDAITIACATRQVINYLNNDHSHAGQGREDLHRAVCRKRGSEWFIRKPWDTFTQDAHARLNQIVISFKQNLRVINKTGNHYWRYNPKTGKKEIFHQQKGDSWAIRQALHKESVFGRVNLRTTKFVSFKEAFASLERIVDKRLKRAILAGMARYSGHCTDKQMLIYLQEQQEWKSFDFKKVAVYTFSEDDDKSRMCAIRKRLDDSFDKKKILSVTDTGIQRILLRHLEQSGGNPKDAFSPEGIVRMNETIQELNGGKPHQPILSVRITETMGNKFAVGMRGNRGKKFVEAAKGTNLFFATYLQEDGKRLFRSLPLNEVVERQKQGLPVAPERDEQGNSLLFVLSPGDLVYLPTSDEQEGRVEPAALDLSRIYKMVSCTRSQCLFVPHRVASVIKDKYEYSSMNKMERAITGEMIKESCLPLEVDRLGRYRIK

SEQ ID NO: 1749 - protein, 1381 aa, unidentified
  REGION 1..1381: note = Description of Unknown:uncultivated organism with predicted taxonomy: Bacteroidales
  REGION 1..1381: note = MG22-95 effector
EADADEEKKKKEVKTLEKATVVSIEQSDAAKGGRYWWNYHLSNGMIYKRTSERPMEWLGTERYFIVTTKLDADGNPKKRKDGTTDKSISAPSADDWGLMKLKTESEIGESGKQLGEFIYDKILADPTAKIIGGEVTVVDRRFYRDELRAILDKQREYIAALRDRELYAECIEALYPSNAAYRNIIAGKDFSYLLTDDVILYQRPLKSKKYLISDCPYETVTFTDKSGQEVTKRLKCVPRSHPLFQEFRVWQFIANLRIYQKERVEGGRKLIDADVTDLLLKNDADRVALFEWLNARADVVQDDLLKFLVAEARKRPISEQSADFGELLVMAHGAKAKKDKAYTAFKWNYVEDKKYPCNKTHSVILSKLSSEEEREALTPEIEEMIWHALYSITDKREFDKAFSPNARHPERGLYATLSRHFSPESIGGIKSIILKESDYGSYSRRALSRLLPLMRCGALWSAEAIDTATRARIDKIIDGEWDEGIDTRTRNLMAGMSTVEQFRGMATWQACYVVYGRHSEASEVMRWNSPDDLRAFITSFPHNSLRNPTVERIILETLRIVEEIWRHYGHIDEIHVELARSVKQNKEQRERAMTQMAENERRNLRLRAMLEAFLNDRDPIGFDPDANINPGSPNQQLKLRLFEDTAFSYAQANGDDQVEEMLNIRNSITGGSDEKSATPAQIRRYALWLEQNFRSPYTGATISLARLFTDDYQVDHIIPQALYWDDSFNNKVLCEGGVNNTKSNALAFDFIAAHQGETIALPNGRKVTILSMEQYQELVLATYKNNRAKCEKLLMKEIPAEFTQRQLNDTRYISKVVKSLLSNVVRERDEEGNLEAEAISKNVIVPVGAMTDRLKQDWGLKDVWNQLMLPRFRALNDKMAPYRFTKITRRGHEIPAMPLELVKGFSKKRIDHRHHAMDAIAIACTTRRHIQYINGDAGEAEADKSKYIDKQRVIDARRTIRNKIAHRLDGDGKPIFDKPWTTFTEDVKRALENLIVSFKQTNKVISHTSNKSQRYVDGQKRFVRQTKGEQIAIRKPLHKETVSALVNLREVKEVTLKEAVATVPTIVDKELRAKIVELIAKGYDEKRMKAYFEEHNDEWTDVNPARKKVKVYRFSEESGSNHYYATRVALDTTFDAKKIRTITDTGIQKILLRYLEAKGSAAVAFTPEGIDELNANIARYNGGRQHQPIVKVRTYVNGDRYAIGTVGNKSKKYVVAQSGTLLYYFAFAHTEYDKKRKEEVTLRVFSAIPLRDVIAAMKADRDNWEDCVTASLKERGIIPADARFLFKLSPGDMIYLPDAHETIAPSAIDRAKVYKVVSFFGDNGGYLFVVPYSVAKPIIDKIEYGTQNKVNLAGELKQRIIPLAVDRLGNITWVYDPAGEK

SEQ ID NO: 1750 - protein, 890 aa, unidentified
  REGION 1..890: note = Description of Unknown:uncultivated organism with predicted taxonomy: Bacteroidales
  REGION 1..890: note = MG22-96 effector
MRVGKYWTADNIDPTTLHRIQLLISGEDDGELNLRTRDKLENLRNIEDFQGLPVWMACYVVYGRHSESGNIQKWSNPHDIDIFLNNFKQHSLHNPIVEQVVLETMRVVRDVWAKFGNLDEIHLELGRNLNQTAEQRKRDTERNLGNERANLRAKILLTEFLNPEMNVENVRPYSPSQLELLRIFEEGILDDSAGNMPDDIQEIIKKLDSTDIKRRPTESEVLRYRNWLEQGYRSPYTNEIIPLSKLFTTAYQIEHIIPQSLYFNNSYNNKVICEAEVNQLKSNQLGMEFVKNHGGEIVECAFGRKVRILTPEEYTAFVEQHYKHNVHKKNNLLSTELPSEFSSRQLNDSRYISKLMIGLLSNIVREETDGHLEEEAISKNLIVCTGKVTERLKQDWGLKDVWNEIIRPRFERLNQMEQTERFGHWENKQGKNVFQITIPIELSSSVDRKRIDHRHHAMDAITIACATRNMVNYLSNQASGKTRFDLQHALCIKQKMDAQGNYKWLIRKPWQTFTEDAKTALNEIVVSFKQNLRVINKTSNHYETIGSDGKKILRRQSKGDSWAIRKSMHKDTVFGNVNLRSIKQVTLKQALQQVDRICSKELKKYILSLQKLHFSGKGIEAQLKEKGRRLFPDIDLKKIDIYYFSNDSENTRMVASRKPLDNSFNQKAIEAITDSGIRKILLNHLEQCNGDSEAAFSPMGIEQMNEHITSLNNGIPHKPIYKVRKSEIQGSKFPVGTKGCRSKKFFEADKGTNLFFAIYVDSEGKRSFDSIPLNIVIERQKQGLPSCPEKDSNGNTLLFCISPSDTVYVPTPDEMETGNIDLNYIDKGRLYKMVSCSGRQCFFLPIEIACMIWDKVEFSATNKMERSITGEMIKDICIPIKCNRLGELLP

SEQ ID NO: 1751 - protein, 1490 aa, unidentified
  REGION 1..1490: note = Description of Unknown:uncultivated organism with predicted taxonomy: Bacteroidetes
  REGION 1..1490: note = MG22-97 effector
MKRVLGLDLGTNSIGWAVVEKDSLNETDGKIIMSGSRIIPMDAAMMSDFDKGNAQSQTAERTRLRSIRKLNERHKIRRQRLNRVLSILKYLPEHYANNIDRYGNIDENKEPKIAWKINSNGRKEFLFMDSFEEMVAEIHQKHPDAKTIPYDWTLYYLRSKALHKPISKFELAWVLHSFLQKRGYYQLRGEEEDSTAKKEEYASLKVISVEDSGDRKGNNTWWNVNLENGLTYKVCLQDRPPLEGKTRDFIITTKLDKEGKPALDKDGKPRYSIRAPKDDDWGLMKIRTESQIAKAGMTVGQYIYNTILNTLDKKIRGQIVRTIERKYYREELLRILECQIMFHLELQDKELYTECIEALYPSNDSYRASIATRNFKYLIADDVIFYQRPLKSKKSEISDCPYETRTFVDKSTGEIKKTSLKCISRQNPLFQEFRLWQFISNLRIYKRYDAEDGRIVINKDITKDLLPDANVVASLYEWLSTKAGVSQEQLLKYLKLSSADYRWNYVEEKKYPAGETRAMLMSGFKKAGIDTNLLTEEIEMALWHILYSVNDRQELIKALSSFAVQHQWPAEVFSNVFCKTKPFEDYGAYSEKAIKKLLPLMRVGKYWTADDIDPATRHRIQLLITGEDDSELNLRTRDKLEDLKSIDDFQGLPVWMACYVVYGRHSESGNILKWSNPHDIDIFLNNFKQHSLHNPIVEQVVLETMRVVRDVWAKFGNLDEIHLELGRNLNQTAEQRKRDTERNLGNERANLRAKILLTEFLNPEMNVENVRPYSPSQQELLRIFEEGIIDDSTGNMPDDIQEIIKKLDSSDIKRRPTESEILRYRNWLEQGYRSPYTNEIIPLSKLFTPAYQIEHIIPQSLYFNNSYNNKVICETEVNQLKSNQLGMEFVKNHGGEIVECAFGRKVRILTPEEYTAFVEQHYKHNIHKKNNLLSTELPSEFSSRQLNDSRYISKLMIGLLSNIVREDADGQLEEEAISKNLIVCTGKVTERLKQDWGLKDVWNEIIRPRFERLNHMEQSERFGHWENKQGKNVFQITIPLELSSSVDRKRIDHRHHAMDAITIACATRNMVNYLSNQASGKARYDLQHVLCVKQKMDAQGNYKWLIRKPWQTFTEDAKAAIKEIVVSFKQNLRVINKTSNHYEAIGSDGKKILRRQTKGDSWAIRKSMHKDTVFGNVNLRSVKQVTLKQALQQVDRICSKELKKYILSLQKLHFSDKGIEAQLKEKGRQLFPNIDLKKIDIYYFSNDSENTRMVATRKPLDASFNQKAIEAITDSGIRKILLNHLEQYNGDSEAAFSPMGIEQMNEHITSLNNGIPHKPIYKVRKSEIQGSKFPVGTKGCRSKKFFEADKGTNLFFAIYVDSEGKRSFDSIPLNIVIERQKQGLPSCPEKDSNGNTLLFCISPGDTVYVPTPDEMETGNIDLNYIDKGRLYKMVSCTGKESHFLPLSSATTIKDKYEYSSLNKLGRALSGEMIKDICIPIKCNRLGELLP

SEQ ID NO: 1752 - protein, 979 aa, unidentified
  REGION 1..979: note = Description of Unknown:uncultivated organism with predicted taxonomy: Bacteroidales
  REGION 1..979: note = MG22-98 effector
MTRKILGLDLGPNSIGWAVIARETSSDEENSGRIIDAGSRIIPMIDDSKFEKGETISATKDRRQKRSMRRMLERKKQRRQRLLRALNVMGFLPEHFAAYIDKHGNMRHDCDTPLMAWEQNADGHRQFIFTDAFEEMVADFRQHAICSCADGKLIPYDWTPYYLRKKALTTAISREELAFVLTQFNKKRGYHQLRGDELDEAEQKSKNQEIRTLTVKEIIDYKKISQKHKYTFLLSNGMAFERESTSKLDDWVGKERDFIITTEYDEEGNIKKNRFGEDKISIRAPEETDWTLRKKKAENDISDKKEVGEYIYDELLRTPDMKIIGGKVMTIDRKFYRRELRKILATQEPYHPELKDESVKRKVAKALYPNNTDHRRAIMRKSLSDIIVDDIIFYQRSLKSKKSTIADCPYEKRYYKDSEGMLKKTGVKCISKSHPLFQEFRTWQFINDLCITRQGEPVDFSNEEAADLFDYLHCKEKTNETDILKNFLKLNKQEQELHKWNYGKDAEKPCCPTHCQFVERFKKIGLEPSILTAETEQVLWEIAYSVKDVAEYNKAIEKFADRIGADREEFTKAFRNLPDYKSEYGSYSHKAICKLLPLMRRGSAWQWEAIDKDTREKIGHIINGEHDERLTEDTRQNFSKKTKEDDFQGLQPWEACQLVYGGQTDDEEIQKWDSPEDVDKYIASFRQHSMRNPVVEQVVLETLRTARDIMRRYGKVDEIHLEMARSMKQTSQQRKADNERMQSNYKRNQEVRDKIAEELQQNATNGERPKIGAKKIASYKIWEDQKGRSPYTGKAISDAALLNADGRYDIDHVIPQSRYYDDSLNNKVICEKEVNLKKGNMLGLEFIQKHGGETIQLSSGGEVTILREEEDKKLVNETFKGRKQKIMLMTETPNDFTNRQKTDTQYIASTMMRLLSNIVREQDPDGSLEREVRSKNPIVCTGGITDKLKKDWGVNDAWNRIILPRFKRMDELTMAERTG

SEQ ID NO: 1753 - protein, 1537 aa, unidentified
  REGION 1..1537: note = Description of Unknown:uncultivated organism with predicted taxonomy:Flavobacteriales
  REGION 1..1537: note = MG22-99 effector
MAKYILGLDLGPNSIGWAVVEGVEQEEHVGLVPQRIVMSGSRIIPIDKTTLSNFETGNTVSQTADRTQKRGMRRNLERKKLRRQRLFRVLKTMGMLPRHFAEHVDGLGNLDEDGRRLSMAWAPQEGERPLFLFQDAFAEMVGEFAARQPQLMLGGKLVPKDWTLYYLRKKGLTDRLEKEELAWVLASFLQKRGYRYMRGQDADNTKENEKKELRTLEIVDLISDGDGSKKGKGVDLVLEDELRFTVKNANEADFKRGQTLDFIVTTTYDERGKVKMDANNKPMRKLSMPKEGDWELLKTRTEQRIRVQEGSTVGSYIYESILENPDVKIIGERVHVVGREFYEEETKRILEAQTQFHPELSDPEMRDKVAHALYPNNEAHRNAILNRSLADIIVADVVFYQRPLRSKKSSISDCPFEKRNYVGSDGEERKVGVKCISKSHPLFQEFRTWQFVGNVKLVSKDDSGDDKNLSLLGRKKCFNGGTCEEGAELFEWLHNRKSVKQGDFLKGFVGLTKGEIDRYYRWNYEADKEIPCCETRAEFLGYFKKAGLPADALTEEAERRLWEVAYSVSDREEFRKALRSYARWIGADEERFVEACGKMKPFPSDYGSYSEKAIKKLLPLMRTGKYWSFDAIAPETQSKIRHLITGEEDERLTDEVREHFKYRVDEANYQGLQLWEACELVYGSSFSKDDIAHWKSPDDLDRWLEGFRQHSLRNPIVEQVVLEAVRTVRDIWRKIGHIDEIHLEMARDMRKTAQERKRDSERNSQNFKARQRIKMLLDEFEKMRIDDVHPYSPMHQEKLRIVEDGVFDRVSAKGDEKSKEMLKDMRAFQTNVEKNNVTPGDISRYMLYLEQNYRSPYTNETISMKRLFSSDYEIEHVIPRSRFFDDSMSNKVICEAKVNKEKGNMTGMEFIMKRGGEKIELGEGREVTIVNEKDYRQYVDEVYKNNSRKRKNLLSEDIPGGFSNSQMNNTRYISRLVMTILSNIVRDDREDGKSDEGIRANRLITCQGGVTDKLKKDWHVNDVWNRIILPRYERMQNEVMKGVTFVTNNSRGHEIPTMPDKLKTEEYNPKRIDHRHHAMDAIVIACATRSIVNFLNNESARDEASEGSEKAKARQTYAELRSLLCVKDADNDEKVIRKPWENFEVDVLKALEDIVVSTKHKQRVLTRTSNHYEKFVDGKKQKVSQKGKSYAVRLSLHKDTVWGQVNLRRQEGVSLLTALKDPQRVVDKALRKKIVELQAQGKKPKDIKKYFAENADVWPETQGKVAVWHFTDDEPTKTYATRFISSLTELFDKISTREKAEEKIQSITDTGIQKILLAHLAECNYDVAEAFSPIGIERMNANIVALNGGKQHKPIKKVRRTESGSKFAVGASSGSRHKFVENAKGGNLFFAVYLAVSEDKNGNEVRKRQYETLPLRTVLDRLKQGLSPVPEVDEGGNRLLFSLCPYDLVYVPKEGENVGELTAERLDKERIYMFVSSSDSDAMFRPHRVAAPIVEKKEFTLHNKMSKAVTGEMIKEVCIPLEVDRLGDITKKRIGDD

SEQ ID NO: 1754 - protein, 1489 aa, unidentified
  REGION 1..1489: note = Description of Unknown:uncultivated organism with predicted taxonomy: Bacteroidales
  REGION 1..1489: note = MG22-100 effector
LGPNSIGWAVVQTELDDEKKDTLYSSGKILMSGSRIIPMSADIMNNFQKGVSVSQTAERTRYRLVRRQYERFHLRRERLNRVLMTMGYLPEHYAEQLDRYGKLPKGKEPKLAWRMAKDGKPEFIFREAFLEMVDEMRAVHPDLQQIPYDWTIYYLRKKALSRALRPEELAWVLHSFNQKRGFFAVRGQVDTDAEAPDKLQEYHKARLASVVDTGEKNRGNAVYRLCFDDGVEFEVALRRMTLQVGDDVEYIKTTKLDDDGMPKQTKQGKPDISYKIPGANDAWTLNKLRAEYTIDQSQSTVGEYIYKALLTNPQQKIRGELVRTIDRHFYRDELRRILQAQKPHHPLLQDQEMLDECLQMLYPHNESHSNSMRGRDLCALLTDDIIMYQRPLKSKKSLIAGCKYETHRYVDKDGKMKTEGVKCASKSHPLFQEFRLWQFIENLRIIQRKDTSNGRVRYDVDVTEQFIHDYEGRAALFEWLQTRSKIKQDALLKHFGMKEEGFRWNYVEDREYPAGETRAEMLKRLKKAGVDADFLTAERELALWEILYSVNGQEELGKALRTFARKHQLDEEKFAQNFCTIKPYPSDYCAFSVKALKRLLPLMRCGKYWTAEQIDASTAQRIQKLIDGEYDEQITEQVRNATATLRSVGDYQGLSTWLASYVVYGRHSEASDTKKWETPEDMEADIKAFRQHSLRNPIVEQVCLETLRTVHDIWKEVGHIDEIHVEMGREMRATAKEREERSARQLRNEQTNLRIKALLQEFMNPALEIEDVRPYSPSQQELLHIYEETVLEQEAGNIDDDIREIIRKFTQTEASKRPTEGEVRRYKLWLEQRYRSPYTGKNIPLGKLFTPAYQIEHVIPQSVYYDNSYNNKVICEAEVNLLKGNMLGMAFIKEHAGEIVPLSLGGEVEILKPDTYREFVEEHYKGRKRQIMLSEEIPTEFTSRQMNDTRYIARFIMGELSKLVRQQNADGTYEEEATSKNVIVLNGAITDKLKKDWGLVDVWNGIIAERFKRLNQMEGGTRFGHEENKDGKRYFQIEMPLELQRGFNRKRIDHRHHAMDAIVIACATRAVVNYLNNDHAHDGAGREDVKRAVSRKRDQTWLINKPWPTFTEEAKEELKQMVVSFKQNLRVINKTSNHYEKYNTATGKKEKFRQHHGDNWAIRKALHKESVFAQVNLRSIQTVNFKTAYEQVLRIVDKRLKRAIRDAKNRYAMRCTDKQILKYLQGMPEWKDYDFKRIAIYAFSNDQEKTQMCAIRKRLDDSFDKKKIASVTDTGIQQILLHHLEENGNNPKEAFSPEGIERMNANIAALNNGKAHQPIYVVRISEPMGQKFAVGHIGNRSKKFVEAAKGTNLFFAIYDLGGDRRGYTSLPFREVVERQKLGYPTAPETDEEGHRLLFVLRPGDLVYVPTEEQLQSRIDARAIDKSRIYKMVSCTGNECHFIPANTASFIRDKYEYGSLNKLARAITGEMIKEICIPLEIDRLGRYRIK

SEQ ID NO: 1755 - protein, 1215 aa, unidentified
  REGION 1..1215: note = Description of Unknown:uncultivated organism with predicted taxonomy: Bacteroidales
  REGION 1..1215: note = MG22-101 effector
RIPNADDAWTLNKLRAEFTIDQSHSTVGQYIFNAILRNPQQKIRGELVRTVDRRFYRDELRRILEVQIPLHPALQDREKLEECLLALYPNNEAHRRSMQGRDFKALLMDDIILYQRPLKSKKSLIGECKYETHTYINKEGKRETIGLKCASRSNPLFQEYRLWQFLENLRILKRKTLDGNHYRTDVDVTTLFLRTDESYTSLFDYLRSRAEIDQKTLLKFFKLKEEDYRWNYVEERKYPTSETRAEMLKRLKKAGVPTEFLTHELEMALWEILYSVSGQSELEKALRKFAEKNNLDQETFYQCFRTIKPYSADYCAFSTKALRRLLPLMRRGHYWNYNAIDPLTQQRIARLINGEEDTTISNRVREKAETLRTETDYQGLPTWLASYVVYGRHSEASEIKKWASPEEMDRDIRCFRQHSLRNPIVEQVCLEALRTVRDIWKEIGSINEIHVELGREMRATAKERESRHNRQLENEQTNLRIKALLQEFMNPEFGIEDVRPYSPNQQELLRIYEDTVLSQEAGRVDEPIREIIRKFSQTDAAKRPTTAEVLRYKLWLEQKYRSPYTGEPISLSKIFTSAYQIEHVIPQSVYYDNSYSNKVICEAEVNLLKGNMLGMPFIMQHAGEKVQCSVGNIVTISTPEAYRAFVEEHYKGKKQKILLSEEIPTNFTARQMNDTRYISRFIIGELSKLVREHNPDGTLEQEAVSKNILILNGAVTDKLKKDWGLVDVWNGIIAPRFRRLNAMEGSQRFGHEAMKDGKRYFQIEMPLELQRGFQRKRIDHRHHAMDAIAIACATRNVVNYLNNDHSHEGAGREDIKRAVSSKRSGQWLVNKPWSTFTQEARKQLQQIVVSFKQNLRVINKTSNRYVRYNPQTRKKETIVQQKGDNWAIRKPLHKESVFGRVNLRTQKAVNFKTAYANIERIVDKRFKHAVLAAIKRYGGKCTDKQVLKYMQGMPEWKDFDFKKVQIYVFSNDDVKTQTSAIRKRLDDSFDKKKILTITDTGIQRILLRHLEQNGNNPKEAFSPEGIVRLNESMLELNGGKPHLPIFAVRISEPLGNKFSVGMRGNRSKKFVEAAKGTNLFFAIYQQEDGRRLYRSVPLNEVIERQKQGLSSAPEHDENGNALLFVLSPGDLVYLPTKEERNSRIDVQAIDKTRIYKMVSCSGNQCQFIPINVASAIVDKYEFSSANKMERAITGEMIKELCLPIEVDRLGRYRLK

SEQ ID NO: 1756 - protein, 1377 aa, unidentified
  REGION 1..1377: note = Description of Unknown:uncultivated organism with predicted taxonomy: Clostridia
  REGION 1..1377: note = MG23-1 effector
MGKKMYVGLDMGTSSVGLAVTDENYKLYRVKGKDYWCSRTFDEADTAVERRTNRISRRRRQREVARLGILRELFADEIAKVDPGFYARLDESKYHLEDRDNKQPYAIFADKGYTDKEYYARYPTIFHLRSELIDSDKPHDVRLVYLALANMFKHRGHFLNDSLSSDKPLADTTEAYSNFYYTASELSISFPAEAQPDSIDAASLEALLGDKGVSRTDKAKNICQYLAIDKKTSKPLYTLINLICGLNIKLIDIYGAELIDEENKKLSIGFRDSSYEQQDADGRKLLGENYAIIDAAKELHDIGLLSSIMKGYKYLSQARVALYEEHAADLKKLKSVLKRYDKDSYRKVFRSMDEGSYSAYIGSVNSGTKIRRGVKDGSADTFCKSMKKVLEKLPKDDMDVQYLLAKATDSSLLPKQLTFENGVIPNQLHAAEMKAILRQAEKYLPFLLEKDEYDLTVSQRIIQLFTFRIPYYVGPIGKNHAGEKGYNIWATRRAGEEDGRVYPWNFEQKIDTKAAAEKFIERMVRHCTYINGERTLPKCSLLYEKYMVLNELNNLRINGEKPAVSVKQDIYTKLFCRGKRVTMKMLKDYLYNSSLIPSKEDVVISGIDNGFNTSLTSVGKFRGILGDAVFADSNQKMIEDIIFWGTVYGNDKKFLKERIEEVYGDRLNHDEIKRILGFNFNDWGNLSREFLELEGECECGRCSIIQAQWNTNHNLMELLSDQFTFKNELEKKTGSAEKALADWSIDDLEGKYLSAPVKRMIWQTIKMLREVCEVTGRTPDKVFVEMAREDGEKGARTVSRKKKLLDLYDAIKHEERELAKVFSDEIDSKTEADFRSKKLYLYYLQQGRCMYSGDIIHLSDLMNDNLYDIDHIYPRHFIKDDSLENNLVLVKKQINNRKQDTFPIERSIQEDMRPFWKSLADSGFISAEKYKRLTRRDAFTDEEKAAFISRQLVETRQGTKAIADILKQALPDTEIVYVKAGLVSDFRQKFELYKVRALNDTHHAKDAYLNIVVGNTYSTKFTNNPLNFIKAGAKRPQDNQFKYNMDKIFDYNVISRGERAWIAGSDGSICTVKKFMSRNTVLITRKAKEVHGALSNKATIWGKNVAKPGAYLPVKSTDLKAQDVTKYGGITSIANSGYTLAEYKVNGKTTRSLEALPVYLGRAEQLTEKTVVDYLSSSLQESSKKKIEDIQVRKLFIPQGSKVKIDGFCYYLGGKTGDSIYLNNAVPLYLSSTSEEYLRKLLKAVENNNYNERDKNGQIILTAPKNVQLLSSIFDKLRSKPFSNNKWNIYFSIVNGKETKVEQLFSKLSIDKQAEVISQIVIWINSSRQNVNLSLIGGSAHSGTQALSKTVSRLNECMLISQSITGIYEHSVDLLTI

SEQ ID NO: 1757 - protein, 1375 aa, unidentified
  REGION 1..1375: note = Description of Unknown:uncultivated organism with predicted taxonomy: Firmicutes
  REGION 1..1375: note = MG23-3 effector
MSEKIPYYIGLDMGTNSVGWAVTDENYKILRGKGKDMWGVRLFDEAQTAAERRTNRVSRRRRQREVARIGLVKEYFADALNAVDPGFMVRLEESKYWLEDRSEENQQKFALFNDKDFTDKEYYTVYPTIFHLRKELIESTEQHDVRLVYLAILNLFKRRGHFLNKSLESDGETMSMAEAYAALVDEAAALEITLPMPIDAKKLEEVLSQKGVSRKFVEQDTNEFFGFSKKASEARELVKLMCGLTGKMRNIYGEELIDDDNKKLALSFRSNDYEEKMNEVAELVGDENMRLLEAVKEVHDIALLANILSGEQYLSVARVKQYNKHKEDLQQLKRVLRTYDKAAYKKMFRVMGKDNYSAYVGSVNYKEHKERRNAGAGKDGESFRKAVEKVIDALPEEAQLDQDVIEIREKIKNEAFLPKQLTSANGIIPNQVHLRELKRILENASGYLPFLNEIDESGLTVKERIAQLYEFQIPYYVGPLSKQNSKNAWANRRPGEEKGRILPWNFEQKIDVNQAAEDFIKRMVRHCSYLDAEFTLPKQSLMYEKYMVLNELNNLRINGEKPTVLQKQQIYNELFGKGKRITQKALINYLKDEGIVEKDSEPIISGIDGDFKASLSTFGKLRTVLKEEARKDSSQEMMDQIVFWATVYGDDKRFIRARIEEHYSEILDDHAIKQLLGMKFNGWGNLSKAFLEMEGASKEDGVYRSVIQALWETNDNLMELLGQRYTYKEELEKRVQTKEKPLAEWTIDDLDGMYLSPSVKRMVWQTLKIIREITEVRGSAPSKIFVEMARDDAQTKAKNKGKRTKSRKDFLLECYKDDKAWKDELTSVDDGELRAKKLYLYYLQMGRCMYSGEAIDLASLMSGNTMYDIDHIHPRHFVKDDSLENNLVLVKKDKNAHKSDNYPLESEIRNKQFGFWKSLLDKGLITKTKFTRLIRSEDFSPEELAGFINRQLVETRQGTKAITKILQQAFPDDDMEVVFTKAGVAAKLRHDFDLVKVRCVNDTHHAHDAYLNIVAGNVYNAKFTSNPLRFIKNEVKKGNASYHMDKIFFRDVKRGNKLVWQAPNNEEKTPGTIAIVREQLARRTVLQTRRSYMAHGILSDATIYSKDTAKTESYRPVKSSDERLSDVKKYGGMTSIKNTAYALVEYTVKGKTIRSLEGVPIYLGNCSKDDKKLLQYLQEILQRENKNKQVENVSVRMYPIRQRSYLKVDGYYYYLGGATGSSVYLLDAMSVYLSKEDMGYVKKVEKAVAQQRYDECTKEGEFVLTREKNMDLYNKLVDKFSHGVFIKRKASILKTLEEGIDVFSELNIEKQCGIIMQIFAWITTSQQNVNLTDIGGVAHAGTLLISKKLSTSREALLIEQSLTGLWSKTTDLLTV

(The sequence listing continues in the following parts.)

What is claimed is:

1. An engineered nuclease system comprising:

a) an endonuclease or a ribonucleic acid encoding said endonuclease, wherein said endonuclease comprises a sequence having at least 80% sequence identity to SEQ ID NO: 1433; and b) an engineered guide ribonucleic acid structure configured to form a complex with said endonuclease, said engineered guide ribonucleic acid structure comprising:

i) a guide ribonucleic acid sequence configured to hybridize to a target deoxyribonucleic acid sequence; and ii) a tracr ribonucleic acid sequence configured to bind to said endonuclease, wherein said engineered guide ribonucleic acid structure comprises a sequence having at least 80% sequence identity to non-degenerate nucleotides of SEQ ID NO: 11145.

2. The engineered nuclease system of claim 1, wherein said engineered guide ribonucleic acid structure comprises a sequence having at least 90% sequence identity to non-degenerate nucleotides of SEQ ID NO: 11145.

3. The engineered nuclease system of claim 2, wherein said engineered guide ribonucleic acid structure comprises the non-degenerate nucleotides of SEQ ID NO: 11145.

4. The engineered nuclease system of claim 1, wherein said tracr ribonucleic acid sequence comprises a sequence having at least 80% sequence identity to SEQ ID NO: 11201.

5. The engineered nuclease system of claim 4, wherein said tracr ribonucleic acid sequence comprises a sequence having at least 90% sequence identity to SEQ ID NO: 11201.

6. The engineered nuclease system of claim 5, wherein said tracr ribonucleic acid sequence comprises the sequence of SEQ ID NO: 11201.

7. The engineered nuclease system of claim 1, wherein said engineered guide ribonucleic acid structure comprises:

a) at least two ribonucleic acid polynucleotides; or b) one ribonucleic acid polynucleotide comprising said guide ribonucleic acid sequence and said tracr ribonucleic acid sequence.

8. The engineered nuclease system of claim 2, wherein said tracr ribonucleic acid sequence comprises the sequence of SEQ ID NO: 11201.

9. The engineered nuclease system of claim 6, wherein said endonuclease comprises a sequence having at least 90% sequence identity to SEQ ID NO: 1433.

10. The engineered nuclease system of claim 9, wherein said endonuclease comprises the sequence of SEQ ID NO: 1433.

11. The engineered nuclease system of claim 6, wherein said endonuclease comprises a RuvC_III domain, wherein said RuvC_III domain comprises a sequence having at least 80% sequence identity to SEQ ID NO: 3253.

12. The engineered nuclease system of claim 11, wherein said RuvC_III domain comprises the sequence of SEQ ID NO: 3253.

13. The engineered nuclease system of claim 12, wherein said endonuclease comprises an HNH domain, wherein said HNH domain comprises a sequence having at least 80% sequence identity to SEQ ID NO: 5068.

14. The engineered nuclease system of claim 13, wherein said HNH domain comprises the sequence of SEQ ID NO: 5068.

15. The engineered nuclease system of claim 6, wherein said endonuclease is a class 2, type II Cas endonuclease.

16. A method of editing a locus in a cell, said method comprising contacting to said cell:

a) an endonuclease or a ribonucleic acid encoding said endonuclease, wherein said endonuclease comprises a sequence having at least 80% sequence identity to SEQ ID NO: 1433; and b) an engineered guide ribonucleic acid structure configured to form a complex with said endonuclease, said engineered guide ribonucleic acid structure comprising:

i) a guide ribonucleic acid sequence configured to hybridize to a target deoxyribonucleic acid sequence; and ii) a tracr ribonucleic acid sequence configured to bind to said endonuclease, wherein said engineered guide ribonucleic acid structure comprises a sequence having at least 80% sequence identity to non-degenerate nucleotides of SEQ ID NO: 11145.

17. The method of claim 16, wherein said engineered guide ribonucleic acid structure comprises a sequence having at least 90% sequence identity to non-degenerate nucleotides of SEQ ID NO: 11145.

18. The method of claim 17, wherein said engineered guide ribonucleic acid structure comprises the non-degenerate nucleotides of SEQ ID NO: 11145.

19. The method of claim 16, wherein said tracr ribonucleic acid sequence comprises a sequence having at least 80% sequence identity to SEQ ID NO: 11201.

20. The method of claim 19, wherein said tracr ribonucleic acid sequence comprises a sequence having at least 90% sequence identity to SEQ ID NO: 11201.

21. The method of claim 20, wherein said tracr ribonucleic acid sequence comprises the sequence of SEQ ID NO: 11201.

22. The method of claim 17, wherein said tracr ribonucleic acid sequence comprises the sequence of SEQ ID NO: 11201.

23. The method of claim 21, wherein said endonuclease comprises a sequence having at least 90% sequence identity to SEQ ID NO: 1433.

24. The method of claim 23, wherein said endonuclease comprises the sequence of SEQ ID NO: 1433.

25. The method of claim 21, wherein said endonuclease comprises a RuvC_III domain, wherein said RuvC_III domain comprises a sequence having at least 80% sequence identity to SEQ ID NO: 3253.

26. The method of claim 25, wherein said RuvC_III domain comprises the sequence of SEQ ID NO: 3253.

27. The method of claim 26, wherein said endonuclease comprises an HNH domain, wherein said HNH domain comprises a sequence having at least 80% sequence identity to SEQ ID NO: 5068.

28. The method of claim 27, wherein said HNH domain comprises the sequence of SEQ ID NO: 5068.

29. The method of claim 21, wherein said endonuclease is a class 2, type II Cas endonuclease.

30. The method of claim 24, further comprising contacting said cell with a deoxyribonucleic acid repair template.

* * * * *